(12) United States Patent
Ratcliffe et al.

(10) Patent No.: US 8,426,685 B2
(45) Date of Patent: Apr. 23, 2013

(54) YIELD-RELATED POLYNUCLEOTIDES AND POLYPEPTIDES IN PLANTS

(75) Inventors: Oliver J. Ratcliffe, Oakland, CA (US); Jose Luis Riechmann, Barcelona (ES); Luc Adam, Hayward, CA (US); Jacqueline E. Heard, Webster Groves, MO (US); Marsha L. Pilgrim, Phoenixville, PA (US); Cai-Zhong Jiang, Fremont, CA (US); T. Lynne Reuber, San Mateo, CA (US); Robert A. Creelman, Castro Valley, CA (US); Omaira Pineda, Vero Beach, FL (US); Guo-Liang Yu, Berkeley, CA (US)

(73) Assignee: Mendel Biotechnology, Inc., Hayward, CA (US)

(*) Notice: Subject to any disclaimer, the term of this patent is extended or adjusted under 35 U.S.C. 154(b) by 378 days.

(21) Appl. No.: 12/638,750

(22) Filed: Dec. 15, 2009

(65) Prior Publication Data

US 2010/0107279 A1 Apr. 29, 2010

Related U.S. Application Data

(60) Continuation-in-part of application No. 11/728,567, filed on Mar. 26, 2007, now Pat. No. 7,635,800, which is a division of application No. 10/225,066, filed on Aug. 9, 2002, now Pat. No. 7,238,860, which is a continuation-in-part of application No. 09/837,944, filed on Apr. 18, 2001, now abandoned, and a continuation-in-part of application No. 10/171,468, filed on Jun. 14, 2002, now abandoned.

(60) Provisional application No. 60/310,847, filed on Aug. 9, 2001, provisional application No. 60/336,049, filed on Nov. 19, 2001, provisional application No. 60/338,692, filed on Dec. 11, 2001.

(51) Int. Cl.
*A01H 5/00* (2006.01)
*A01H 5/10* (2006.01)
*C12N 15/82* (2006.01)

(52) U.S. Cl.
USPC .................................................. 800/298

(58) Field of Classification Search ............ None
See application file for complete search history.

(56) References Cited

U.S. PATENT DOCUMENTS

| | | | |
|---|---|---|---|
| 5,891,859 A | 4/1999 | Thomashow et al. | |
| 5,892,009 A | 4/1999 | Thomashow et al. | |
| 5,929,305 A | 7/1999 | Thomashow et al. | |
| 5,965,705 A | 10/1999 | Thomashow et al. | |
| 5,994,622 A * | 11/1999 | Jofuku et al. | 800/260 |
| 6,121,513 A | 9/2000 | Zhang et al. | |
| 6,417,428 B1 | 7/2002 | Thomashow et al. | |
| 6,664,446 B2 | 12/2003 | Heard et al. | |
| 6,706,866 B1 | 3/2004 | Thomashow et al. | |
| 6,717,034 B2 | 4/2004 | Jiang et al. | |
| 6,835,540 B2 | 12/2004 | Broun et al. | |
| 6,946,586 B1 | 9/2005 | Fromm et al. | |
| 7,109,393 B2 | 9/2006 | Gutterson et al. | |
| 7,135,616 B2 | 11/2006 | Heard et al. | |
| 7,193,129 B2 | 3/2007 | Reuber et al. | |
| 7,196,245 B2 | 3/2007 | Jiang et al. | |
| 7,223,904 B2 | 5/2007 | Heard et al. | |
| 7,238,860 B2 | 7/2007 | Ratcliffe et al. | |
| 7,345,217 B2 | 3/2008 | Zhang et al. | |
| 7,511,190 B2 | 3/2009 | Creelman et al. | |
| 7,598,429 B2 | 10/2009 | Heard et al. | |
| 7,601,893 B2 | 10/2009 | Reuber et al. | |
| 7,635,800 B2 | 12/2009 | Ratcliffe et al. | |
| 2003/0041356 A1 | 2/2003 | Reuber et al. | |
| 2003/0061637 A1 | 3/2003 | Jiang et al. | |
| 2003/0093837 A1 | 5/2003 | Keddie et al. | |
| 2003/0101481 A1 | 5/2003 | Zhang et al. | |
| 2003/0121070 A1 | 6/2003 | Adam et al. | |
| 2003/0131386 A1 | 7/2003 | Samaha et al. | |
| 2003/0188330 A1 | 10/2003 | Heard et al. | |
| 2004/0098764 A1 | 5/2004 | Heard et al. | |
| 2004/0128712 A1 | 7/2004 | Jiang et al. | |
| 2005/0086718 A1 | 4/2005 | Heard et al. | |
| 2005/0097638 A1 | 5/2005 | Jiang et al. | |
| 2005/0155117 A1 | 7/2005 | Century et al. | |
| 2005/0172364 A1 | 8/2005 | Heard et al. | |
| 2006/0008874 A1 | 1/2006 | Creelman et al. | |

(Continued)

FOREIGN PATENT DOCUMENTS

| | | |
|---|---|---|
| EP | 1406483 | 2/2002 |
| WO | WO03/013227 | 8/2003 |

(Continued)

OTHER PUBLICATIONS

Reichmann J.L. et al. The AP2/EREBP family of plant transcription factors. Biol Chem. Jun. 1998;379(6):633-46. Review.*
Doerks T. et al. Protein annotation: detective work for function prediction. Trends Genet. Jun. 1998;14(6):248-50.*
U.S. Appl. No. 10/171,468, filed Jun. 14, 2002, Creelman, Robert et al.
U.S. Appl. No. 09/394,519, filed Sep. 13, 1999, Zhang, J. et al.
U.S. Appl. No. 12/573,311, filed Oct. 5, 2009, Heard, J. et al.
U.S. Appl. No. 12/577,662, filed Oct. 12, 2009, Reuber, T. et al.
U.S. Appl. No. 12/557,449, filed Sep. 10, 2009, Repetti, P. et al.
U.S. Appl. No. 09/627,348, filed Jul. 28, 2000, Thomashow, Michael et al.
U.S. Appl. No. 09/489,376, filed Jan. 21, 2000, Heard, J. et al.
U.S. Appl. No. 09/489,230, filed Jan. 21, 2000, Broun, P. et al.
U.S. Appl. No. 09/506,720, filed Feb. 17, 2000, Keddie, James et al.

(Continued)

*Primary Examiner* — Cynthia Collins
(74) *Attorney, Agent, or Firm* — Yifan Mao; Jeffrey M. Libby

(57) ABSTRACT

The invention relates to plant AP2 protein family polypeptides, polynucleotides that encode them, homologs from a variety of plant species, and methods of using the polynucleotides and polypeptides to produce transgenic plants having advantageous properties, including greater tolerance to freezing, as compared to a reference plant.

16 Claims, 1 Drawing Sheet

U.S. PATENT DOCUMENTS

| | | | |
|---|---|---|---|
| 2006/0015972 A1 | 1/2006 | Heard et al. |
| 2006/0162018 A1 | 7/2006 | Gutterson et al. |
| 2006/0242738 A1 | 10/2006 | Sherman et al. |
| 2006/0272060 A1 | 11/2006 | Heard et al. |
| 2007/0022495 A1 | 1/2007 | Reuber et al. |
| 2007/0101454 A1 | 5/2007 | Jiang et al. |
| 2007/0199107 A1 | 8/2007 | Ratcliffe et al. |
| 2007/0226839 A1 | 9/2007 | Gutterson et al. |
| 2008/0010703 A1 | 1/2008 | Creelman et al. |
| 2008/0155706 A1 | 6/2008 | Riechmann et al. |
| 2008/0163397 A1 | 7/2008 | Ratcliffe et al. |
| 2008/0229448 A1 | 9/2008 | Libby et al. |
| 2008/0301836 A1 | 12/2008 | Century et al. |
| 2008/0301840 A1 | 12/2008 | Gutterson et al. |
| 2008/0301841 A1 | 12/2008 | Ratcliffe et al. |
| 2008/0313756 A1 | 12/2008 | Zhang et al. |
| 2009/0049566 A1 | 2/2009 | Zhang et al. |
| 2009/0138981 A1 | 5/2009 | Repetti et al. |
| 2009/0151015 A1 | 6/2009 | Adam et al. |
| 2009/0192305 A1 | 7/2009 | Riechmann et al. |
| 2009/0205063 A1 | 8/2009 | Zhang et al. |
| 2009/0265807 A1 | 10/2009 | Kumimoto et al. |
| 2009/0265813 A1 | 10/2009 | Gutterson et al. |
| 2009/0276912 A1 | 11/2009 | Sherman et al. |

FOREIGN PATENT DOCUMENTS

| | | |
|---|---|---|
| WO | WO2004/076638 | 9/2004 |
| WO | WO2005/047516 | 5/2005 |
| WO | WO2007/028165 | 3/2007 |

OTHER PUBLICATIONS

U.S. Appl. No. 09/533,030, filed Mar. 22, 2000, Keddie, James et al.
U.S. Appl. No. 09/533,392, filed Mar. 22, 2000, Wang, C-Z. et al.
U.S. Appl. No. 09/532,591, filed Mar. 22, 2000, Samaha, R. et al.
U.S. Appl. No. 09/533,648, filed Mar. 22, 2000, Riechmann, Jose Luis et al.
U.S. Appl. No. 10/290,627, filed Nov. 7, 2002, Riechmann, Jose Luis et al.
U.S. Appl. No. 09/713,994, filed Nov. 16, 2000, Keddie, James et al.
U.S. Appl. No. 09/837,944, filed Apr. 18, 2001, Creelman, Robert et al.
U.S. Appl. No. 09/594,214, filed Jun. 14, 2000, Jones, J. et al.
U.S. Appl. No. 10/456,882, filed Jun. 6, 2003, Riechmann, Jose Luis et al.
U.S. Appl. No. 12/376,569, filed Aug. 3, 2007, Creelman, Robert et al.
U.S. Appl. No. 12/526,042, filed Feb. 7, 2008, Repetti, Peter P. et al.
U.S. Appl. No. 12/638,750, filed Dec. 15, 2009, Ratcliffe. O. et al.
NCBI Accession No. AB052729 (Apr. 16, 2001). *Pisum sativum* mRNA for DNA-binding protein DF1, complete cds.
NCBI Accession No. BE461934 (Jul. 27, 2000) .EST413449 tomato breaker fruit, TIGR *Solanum lycopersicum* cDNA clone cLEG40N4, mRNA sequence.
NCBI Accession No. AI727052 (Jun. 11, 1999). BNLGHi7234 Six-day Cotton fiber *Gossypium hirsutum* cDNA 5—similar to (AJ003215) GTL1 [*Arabidopsis thaliana*], mRNA sequence.
NCBI Accession No. AL509143 (Jan. 4, 2001). AL509143 *Hordeum vulgare* Barke developing caryopsis (3.-15.DAP) *Hordeum vulgare* subsp. vulgare cDNA clone HY10N10 5-, mRNA sequence.
NCBI Accession No. BG446849 (Mar. 15, 2001). GA__Eb0039I22f *Gossypium arboreum* 7-10 dpa fiber library *Gossypium arboreum* cDNA clone GA__Eb0039I22f, mRNA sequence.
NCBI Accession No. AW686754 (Apr. 14, 2000). NF042C08NR1F1000 Nodulated root *Medicago truncatula* cDNA clone NF042C08NR 5-, mRNA sequence.
NCBI Accession No. AW596787 (Mar. 22, 2000). sj16f10.y1 Gm-c1032 Glycine max cDNA clone Genome Systems Clone ID: Gm-c1032-2084 5—similar to TR:O48592 O48592 GT2 Gene. [1] ;, mRNA.
NCBI Accession No. BI071826 (Jun. 19, 2001). C064P49U Populus strain T89 leaves *Populus tremula* x *Populus tremuloides* cDNA, mRNA sequence.
NCBI Accession No. BE429942 (Jul. 24, 2000). TAS005. D07R990624 ITEC TAS Wheat cDNA Library *Triticum aestivum* cDNA clone TAS005.D07, mRNA sequence.
NCBI Accession No. X68261 (OGST2) (Apr. 20, 1993). *O.sativa* gt-2 gene.
NCBI Accession No. GI 13786451 (AAK39576) (Apr. 25, 2001). putative transcription factor [*Oryza sativa* Japonica Group].
NCBI Accession No. GI 13646986 (BAB41080) (Apr. 16, 2001). DNA-binding protein DF1 [*Pisum sativum*].
Smalle J, et al the trihelix DNA-binding motif in higher plants is not restricted to the transcription factors GT-1 and GT-2. Proc Natl Acad Sci U S A. Mar. 17, 1998;95(6):3318.
Dehesh K, et al.( Nov. 1992) GT-2: a transcription factor with twin autonomous DNA-binding domains of closely related but different target sequence specificity. EMBO J.;11:41.
Fowler, S. et al.; "*Arabidopsis transcriptome* Profiling Indicates that Multiple Regulatory Pathways are Activated During Cold Acclimation in Addition to the CBF Cold Response Pathway"; The Plant Cell; vol. 14, pp. 1675-1690; Aug. 2002.
Gilmour, S. J. et al.; "Low Temperature Regulation of the *Arabidopsis* CBF Family of AP2 Transcriptional Activators as an Early Step in Cold Induced COR Gene Expression"; The Plant Journal; vol. 16 (4), pp. 433-442; 1998.
Gilmour, S.J. et al.; "Overexpression of the *Arabidopsis* CBF3 Transcriptional Activator Mimics Multiple Biochemical Changes Associated with Cold Acclimation"; Plant Physiology; vol. 124; 1854-1865; Dec. 2000.
Haake V. et al.; "Transcription Factor CBF4 is a Regulator of Drought Adaptation in *Arabidopsis*"; Plant Physiology; vol. 130; pp. 639-648; Oct. 2002.
Hsieh, TH et al.; "Heterology Expression of the *Arabidopsis* C-Repeat/Dehydration Response Element Binding Factor 1 Gene Confers Elevated Tolerance to Chilling and Oxidative Stresses in Transgenic Tomato"; Plant Physiology; vol. 129; pp. 1086-1094; Jul. 2002.
Hsieh, TH et al.; "Tomato Plants Ectopically Expressing Arabidopsis CBF1 Show Enhanced Resistance to Water Deficit Stress"; Plant Physiology; vol. 130; pp. 618-626; Oct. 2002.
Jaglo-Ottosen, K.R. et al.; "*Arabidopsis* CBF1 Overexpression Induces COR Genes and Enhances Freezing Tolerance"; Science; vol. 280; pp. 104-106; Apr. 3, 1998.
Jaglo, K. R. et al.; "Components of the *Arabidopsis* C-Repeat/Dehydration-Responsive Element Binding Factor Cold-Response Pathway are Conserved in *Brassica napus* and Other Plant Species"; Plant Physiology; vol. 127; pp. 910-917; Nov. 2001.
Sakuma, Y. et al.; "DNA-Binding Specificity of the ERF/AP2 Domain of *Arabidopsis* DREBs, Transcription Factors Involved in Dehydration- and Cold-Inducible Gene Expression";. Biochemical Biophysical Research Communication; vol. 290: 998-1009; 2002.
Seki, M. et al.; "Monitoring the Expression Pattern of 1300 *Arabidopsis* Genes Under Drought and Cold Stresses by Using a Full-Length cDNA Microarray"; The Plant Cell; vol. 13; pp. 61-72; Jan. 2001.
Shinozaki, K. et al.; "Molecular Responses to Dehydration and Low Temperature: Differences and Cross-Talk Between Two Stress Signaling Pathways"; Current Opinion in Plant Biology; vol. 3; pp. 217-223; 2000.
Shinozaki, K. et al.; "Regulatory Network of Gene Expression in the Drought and Cold Stress Responses"; Current Opinion Plant Biology; vol. 6; pp. 410-417; 2003.
Zhang, J. Z.., et al.; "From Laboratory to Field. Using Information from *Arabidopsis* to Engineer Salt, Cold, and Drought Tolerance in Crops"; Plant Physiology; vol. 135; pp. 615-621; Jun. 2004.

\* cited by examiner

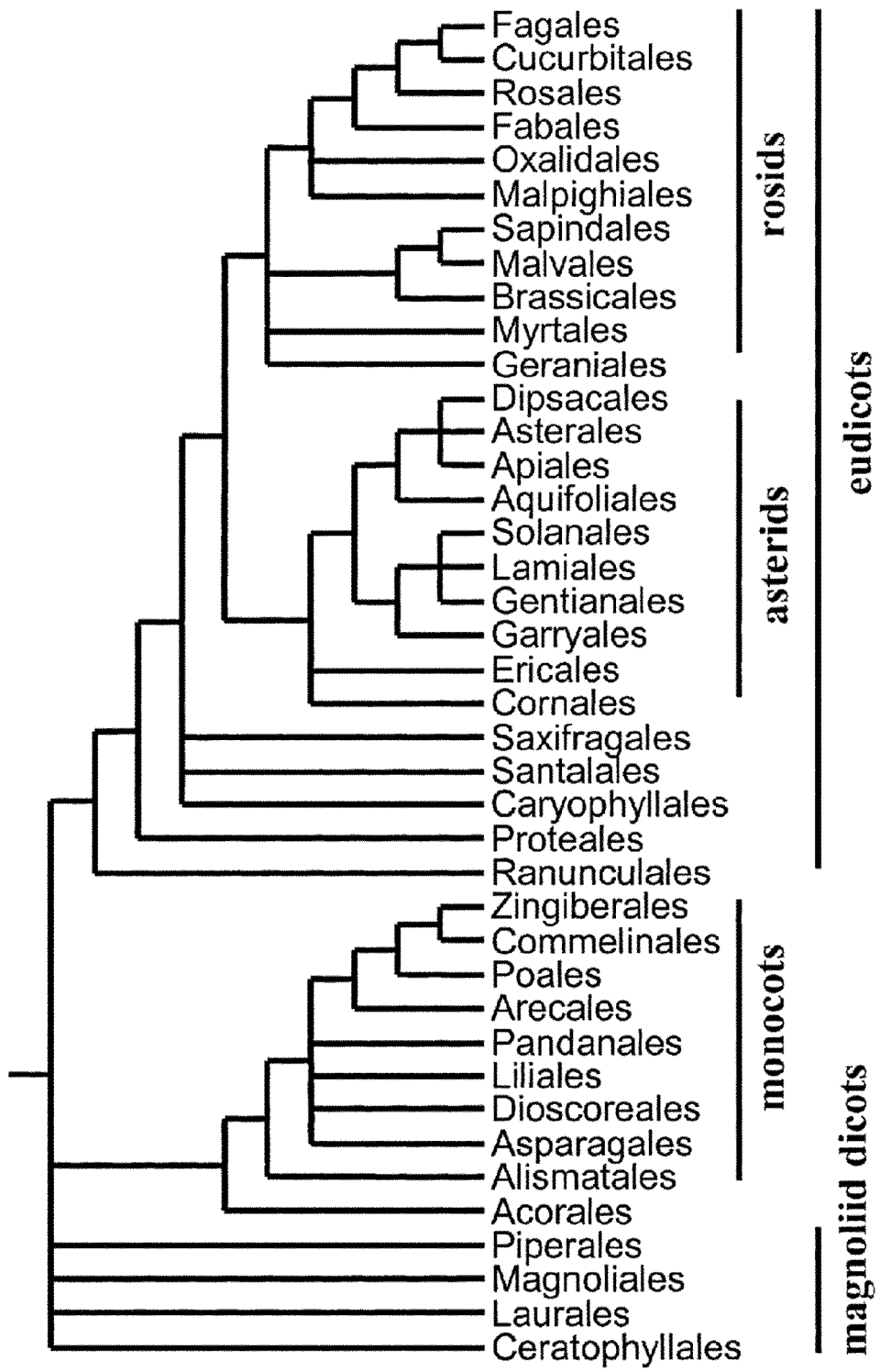

YIELD-RELATED POLYNUCLEOTIDES AND POLYPEPTIDES IN PLANTS

This application is a continuation-in-part of prior U.S. patent application Ser. No. 11/728,567, filed Mar. 26, 2007 (pending), which is a divisional of U.S. patent application Ser. No. 10/225,066, filed Aug. 9, 2002 (issued as U.S. Pat. No. 7,238,860), which claims the benefit of U.S. provisional patent application No. 60/310,847, filed Aug. 9, 2001, provisional patent application No. 60/336,049, filed Nov. 19, 2001, and provisional patent application No. 60/338,692, filed Dec. 11, 2001. U.S. patent application Ser. No. 10/225,066 is also a continuation-in-part of U.S. patent application Ser. No. 09/837,944, filed Apr. 18, 2001 (abandoned); and, U.S. patent application Ser. No. 10/225,066 is also a continuation-in-part of U.S. patent application Ser. No. 10/171,468, filed Jun. 14, 2002 (abandoned). All of these applications are hereby incorporated by reference in their entirety.

JOINT RESEARCH AGREEMENT

The claimed invention, in the field of functional genomics and the characterization of plant genes for the improvement of plants, was made by or on behalf of Mendel Biotechnology, Inc. and Monsanto Company as a result of activities undertaken within the scope of a joint research agreement, said agreement having been in effect on or before the date the claimed invention was made.

FIELD OF THE INVENTION

This invention relates to the field of plant biology. More particularly, the present invention pertains to compositions and methods for phenotypically modifying a plant.

INTRODUCTION

A plant's traits, such as its biochemical, developmental, or phenotypic characteristics, may be controlled through a number of cellular processes. One important way to manipulate that control is through transcription factors—proteins that influence the expression of a particular gene or sets of genes. Transformed and transgenic plants that comprise cells having altered levels of at least one selected transcription factor, for example, possess advantageous or desirable traits. Strategies for manipulating traits by altering a plant cell's transcription factor content can therefore result in plants and crops with commercially valuable properties. Applicants have identified polynucleotides encoding transcription factors, developed numerous transgenic plants using these polynucleotides, and have analyzed the plants for a variety of important traits. In so doing, applicants have identified important polynucleotide and polypeptide sequences for producing commercially valuable plants and crops as well as the methods for making them and using them. Other aspects and embodiments of the invention are described below and can be derived from the teachings of this disclosure as a whole.

BACKGROUND OF THE INVENTION

Transcription factors can modulate gene expression, either increasing or decreasing (inducing or repressing) the rate of transcription. This modulation results in differential levels of gene expression at various developmental stages, in different tissues and cell types, and in response to different exogenous (e.g., environmental) and endogenous stimuli throughout the life cycle of the organism.

Because transcription factors are key controlling elements of biological pathways, altering the expression levels of one or more transcription factors can change entire biological pathways in an organism. For example, manipulation of the levels of selected transcription factors may result in increased expression of economically useful proteins or metabolic chemicals in plants or to improve other agriculturally relevant characteristics. Conversely, blocked or reduced expression of a transcription factor may reduce biosynthesis of unwanted compounds or remove an undesirable trait. Therefore, manipulating transcription factor levels in a plant offers tremendous potential in agricultural biotechnology for modifying a plant's traits.

The present invention provides novel transcription factors useful for modifying a plant's phenotype in desirable ways.

SUMMARY OF THE INVENTION

In a first aspect, the invention relates to a recombinant polynucleotide comprising a nucleotide sequence selected from the group consisting of: (a) a nucleotide sequence encoding a polypeptide comprising a polypeptide sequence selected from those of the Sequence Listing, SEQ ID NOs:2 to 2N, where N=2-561, or those listed in Table 5, or a complementary nucleotide sequence thereof; (b) a nucleotide sequence encoding a polypeptide comprising a variant of a polypeptide of (a) having one or more, or between 1 and about 5, or between 1 and about 10, or between 1 and about 30, conservative amino acid substitutions; (c) a nucleotide sequence comprising a sequence selected from those of SEQ ID NOs:1 to (2N−1), where N=2-561, or those included in Table 5, or a complementary nucleotide sequence thereof; (d) a nucleotide sequence comprising silent substitutions in a nucleotide sequence of (c); (e) a nucleotide sequence which hybridizes under stringent conditions over substantially the entire length of a nucleotide sequence of one or more of: (a), (b), (c), or (d); (f) a nucleotide sequence comprising at least 10 or 15, or at least about 20, or at least about 30 consecutive nucleotides of a sequence of any of (a)-(e), or at least 10 or 15, or at least about 20, or at least about 30 consecutive nucleotides outside of a region encoding a conserved domain of any of (a)-(e); (g) a nucleotide sequence comprising a subsequence or fragment of any of (a)-(f), which subsequence or fragment encodes a polypeptide having a biological activity that modifies a plant's characteristic, functions as a transcription factor, or alters the level of transcription of a gene or transgene in a cell; (h) a nucleotide sequence having at least 31% sequence identity to a nucleotide sequence of any of (a)-(g); (i) a nucleotide sequence having at least 60%, or at least 70%, or at least 80%, or at least 90%, or at least 95% sequence identity to a nucleotide sequence of any of (a)-(g) or a 10 or 15 nucleotide, or at least about 20, or at least about 30 nucleotide region of a sequence of (a)-(g) that is outside of a region encoding a conserved domain; (j) a nucleotide sequence that encodes a polypeptide having at least 31% sequence identity to a polypeptide listed in Table 5, or the Sequence Listing; (k) a nucleotide sequence which encodes a polypeptide having at least 60%, or at least 70%, or at least 80%, or at least 90%, or at least 95% sequence identity to a polypeptide listed in Table 5, or the Sequence Listing; and (l) a nucleotide sequence that encodes a conserved domain of a polypeptide having at least 85%, or at least 90%, or at least 95%, or at least 98% sequence identity to a conserved domain of a polypeptide listed in Table 5, or the Sequence Listing. The recombinant polynucleotide may further comprise a constitutive, inducible, or tissue-specific promoter operably linked to the nucleotide sequence. The invention also relates to compositions comprising at least two of the above-described polynucleotides.

In a second aspect, the invention comprises an isolated or recombinant polypeptide comprising a subsequence of at least about 10, or at least about 15, or at least about 20, or at least about 30 contiguous amino acids encoded by the recombinant or isolated polynucleotide described above, or comprising a subsequence of at least about 8, or at least about 12, or at least about 15, or at least about 20, or at least about 30 contiguous amino acids outside a conserved domain.

In a third aspect, the invention comprises an isolated or recombinant polynucleotide that encodes a polypeptide that is a paralog of the isolated polypeptide described above. In one aspect, the invention is a paralog which, when expressed in *Arabidopsis*, modifies a trait of the *Arabidopsis* plant.

In a fourth aspect, the invention comprises an isolated or recombinant polynucleotide that encodes a polypeptide that is an ortholog of the isolated polypeptide described above. In one aspect, the invention is an ortholog which, when expressed in *Arabidopsis*, modifies a trait of the *Arabidopsis* plant.

In a fifth aspect, the invention comprises an isolated polypeptide that is a paralog of the isolated polypeptide described above. In one aspect, the invention is a paralog which, when expressed in *Arabidopsis*, modifies a trait of the *Arabidopsis* plant.

In a sixth aspect, the invention comprises an isolated polypeptide that is an ortholog of the isolated polypeptide described above. In one aspect, the invention is an ortholog which, when expressed in *Arabidopsis*, modifies a trait of the *Arabidopsis* plant.

The present invention also encompasses transcription factor variants. A preferred transcription factor variant is one having at least 40% amino acid sequence identity, a more preferred transcription factor variant is one having at least 50% amino acid sequence identity and a most preferred transcription factor variant is one having at least 65% amino acid sequence identity to the transcription factor amino acid sequence SEQ ID NOs:2 to 2N, where N=2-561, and which contains at least one functional or structural characteristic of the transcription factor amino acid sequence. Sequences having lesser degrees of identity but comparable biological activity are considered to be equivalents.

In another aspect, the invention is a transgenic plant comprising one or more of the above-described isolated or recombinant polynucleotides. In yet another aspect, the invention is a plant with altered expression levels of a polynucleotide described above or a plant with altered expression or activity levels of an above-described polypeptide. Further, the invention is a plant lacking a nucleotide sequence encoding a polypeptide described above or substantially lacking a polypeptide described above. The plant may be any plant, including, but not limited to, *Arabidopsis*, mustard, soybean, wheat, corn, potato, cotton, rice, oilseed rape, sunflower, alfalfa, sugarcane, turf, banana, blackberry, blueberry, strawberry, raspberry, cantaloupe, carrot, cauliflower, coffee, cucumber, eggplant, grapes, honeydew, lettuce, mango, melon, onion, papaya, peas, peppers, pineapple, pumpkin, spinach, squash, sweet corn, tobacco, tomato, watermelon, rosaceous fruits, vegetable brassicas, and mint or other labiates. In yet another aspect, the inventions is an isolated plant material of a plant, including, but not limited to, plant tissue, fruit, seed, plant cell, embryo, protoplast, pollen, and the like. In yet another aspect, the invention is a transgenic plant tissue culture of regenerable cells, including, but not limited to, embryos, meristematic cells, microspores, protoplast, pollen, and the like.

In yet another aspect the invention is a transgenic plant comprising one or more of the above described polynucleotides wherein the encoded polypeptide is expressed and regulates transcription of a gene.

In a further aspect the invention provides a method of using the polynucleotide composition to breed a progeny plant from a transgenic plant including crossing plants, producing seeds from transgenic plants, and methods of breeding using transgenic plants, the method comprising transforming a plant with the polynucleotide composition to create a transgenic plant, crossing the transgenic plant with another plant, selecting seed, and growing the progeny plant from the seed.

In a further aspect, the invention provides a progeny plant derived from a parental plant wherein said progeny plant exhibits at least three fold greater messenger RNA levels than said parental plant, wherein the messenger RNA encodes a DNA-binding protein which is capable of binding to a DNA regulatory sequence and inducing expression of a plant trait gene, wherein the progeny plant is characterized by a change in the plant trait compared to said parental plant. In yet a further aspect, the progeny plant exhibits at least ten fold greater messenger RNA levels compared to said parental plant. In yet a further aspect, the progeny plant exhibits at least fifty fold greater messenger RNA levels compared to said parental plant.

In a further aspect, the invention relates to a cloning or expression vector comprising the isolated or recombinant polynucleotide described above or cells comprising the cloning or expression vector.

In yet a further aspect, the invention relates to a composition produced by incubating a polynucleotide of the invention with a nuclease, a restriction enzyme, a polymerase; a polymerase and a primer; a cloning vector, or with a cell.

Furthermore, the invention relates to a method for producing a plant having a modified trait. The method comprises altering the expression of an isolated or recombinant polynucleotide of the invention or altering the expression or activity of a polypeptide of the invention in a plant to produce a modified plant, and selecting the modified plant for a modified trait. In one aspect, the plant is a monocot plant. In another aspect, the plant is a dicot plant. In another aspect the recombinant polynucleotide is from a dicot plant and the plant is a monocot plant. In yet another aspect the recombinant polynucleotide is from a monocot plant and the plant is a dicot plant. In yet another aspect the recombinant polynucleotide is from a monocot plant and the plant is a monocot plant. In yet another aspect the recombinant polynucleotide is from a dicot plant and the plant is a dicot plant.

In another aspect, the invention is a transgenic plant comprising an isolated or recombinant polynucleotide encoding a polypeptide wherein the polypeptide is selected from the group consisting of SEQ ID NOs: 2-2N, where N=2-561. In yet another aspect, the invention is a plant with altered expression levels of a polypeptide described above or a plant with altered expression or activity levels of an above-described polypeptide. Further, the invention is a plant lacking a polynucleotide sequence encoding a polypeptide described above or substantially lacking a polypeptide described above. The plant may be any plant, including, but not limited to, *Arabidopsis*, mustard, soybean, wheat, corn, potato, cotton, rice, oilseed rape, sunflower, alfalfa, sugarcane, turf, banana, blackberry, blueberry, strawberry, raspberry, cantaloupe, carrot, cauliflower, coffee, cucumber, eggplant, grapes, honeydew, lettuce, mango, melon, onion, papaya, peas, peppers, pineapple, pumpkin, spinach, squash, sweet corn, tobacco, tomato, watermelon, rosaceous fruits, vegetable brassicas, and mint or other labiates. In yet another aspect, the inventions is an isolated plant material of a plant, including, but not limited to, plant tissue, fruit, seed, plant cell, embryo, protoplast, pollen, and the like. In yet another aspect, the invention is a transgenic plant tissue culture of regenerable cells, including, but not limited to, embryos, meristematic cells, microspores, protoplast, pollen, and the like.

In another aspect, the invention relates to a method of identifying a factor that is modulated by or interacts with a polypeptide encoded by a polynucleotide of the invention. The method comprises expressing a polypeptide encoded by the polynucleotide in a plant; and identifying at least one factor that is modulated by or interacts with the polypeptide. In one embodiment the method for identifying modulating or interacting factors is by detecting binding by the polypeptide to a promoter sequence, or by detecting interactions between an additional protein and the polypeptide in a yeast two hybrid system, or by detecting expression of a factor by hybridization to a microarray, subtractive hybridization, or differential display.

In yet another aspect, the invention is a method of identifying a molecule that modulates activity or expression of a polynucleotide or polypeptide of interest. The method comprises placing the molecule in contact with a plant comprising the polynucleotide or polypeptide encoded by the polynucleotide of the invention and monitoring one or more of the expression level of the polynucleotide in the plant, the expression level of the polypeptide in the plant, and modulation of an activity of the polypeptide in the plant.

In yet another aspect, the invention relates to an integrated system, computer or computer readable medium comprising one or more character strings corresponding to a polynucleotide of the invention, or to a polypeptide encoded by the polynucleotide. The integrated system, computer or computer readable medium may comprise a link between one or more sequence strings to a modified plant trait.

In yet another aspect, the invention is a method for identifying a sequence similar or homologous to one or more polynucleotides of the invention, or one or more polypeptides encoded by the polynucleotides. The method comprises providing a sequence database, and querying the sequence database with one or more target sequences corresponding to the one or more polynucleotides or to the one or more polypeptides to identify one or more sequence members of the database that display sequence similarity or homology to one or more of the one or more target sequences.

The method may further comprise of linking the one or more of the polynucleotides of the invention, or encoded polypeptides, to a modified plant phenotype.

BRIEF DESCRIPTION OF THE SEQUENCE LISTING AND FIGURE

The Sequence Listing provides exemplary polynucleotide and polypeptide sequences of the invention. The traits associated with the use of the sequences are included in the Examples.

Incorporation of the Sequence Listing. The copy of the Sequence Listing, being submitted electronically with this patent application, provided under 37 CFR §1.821-1.825, is a read-only memory computer-readable file in ASCII text format. The Sequence Listing is named "SeqList_0036-2CIP1.txt". The electronic file of the Sequence Listing was created on Dec. 15, 2009, and is 2,602,262 bytes in size (2542 kilobytes measured in MS-WINDOWS). The Sequence Listing is herein incorporated by reference in its entirety.

FIG. 1 shows a phylogenic tree of related plant families adapted from Daly et al. (2001 *Plant Physiology* 127:1328-1333).

DETAILED DESCRIPTION OF EXEMPLARY EMBODIMENTS

In an important aspect, the present invention relates to polynucleotides and polypeptides, e.g. for modifying phenotypes of plants. Throughout this disclosure, various information sources are referred to and/or are specifically incorporated. The information sources include scientific journal articles, patent documents, textbooks, and World Wide Web browser-inactive page addresses, for example. While the reference to these information sources clearly indicates that they can be used by one of skill in the art, applicants specifically incorporate each and every one of the information sources cited herein, in their entirety, whether or not a specific mention of "incorporation by reference" is noted. The contents and teachings of each and every one of the information sources can be relied on and used to make and use embodiments of the invention.

It must be noted that as used herein and in the appended claims, the singular forms "a," "an," and "the" include plural reference unless the context clearly dictates otherwise. Thus, for example, a reference to "a plant" includes a plurality of such plants, and a reference to "a stress" is a reference to one or more stresses and equivalents thereof known to those skilled in the art, and so forth.

The polynucleotide sequences of the invention encode polypeptides that are members of well-known transcription factor families, including plant transcription factor families, as disclosed in Table 5. Generally, the transcription factors encoded by the present sequences are involved in cell differentiation and proliferation and the regulation of growth. Accordingly, one skilled in the art would recognize that by expressing the present sequences in a plant, one may change the expression of autologous genes or induce the expression of introduced genes. By affecting the expression of similar autologous sequences in a plant that have the biological activity of the present sequences, or by introducing the present sequences into a plant, one may alter a plant's phenotype to one with improved traits. The sequences of the invention may also be used to transform a plant and introduce desirable traits not found in the wild-type cultivar or strain. Plants may then be selected for those that produce the most desirable degree of over- or under-expression of target genes of interest and coincident trait improvement.

The sequences of the present invention may be from any species, particularly plant species, in a naturally occurring form or from any source whether natural, synthetic, semi-synthetic or recombinant. The sequences of the invention may also include fragments of the present amino acid sequences. In this context, a "fragment" refers to a fragment of a polypeptide sequence which is at least 5 to about 15 amino acids in length, most preferably at least 14 amino acids, and which retain some biological activity of a transcription factor. Where "amino acid sequence" is recited to refer to an amino acid sequence of a naturally occurring protein molecule, "amino acid sequence" and like terms are not meant to limit the amino acid sequence to the complete native amino acid sequence associated with the recited protein molecule.

As one of ordinary skill in the art recognizes, transcription factors can be identified by the presence of a region or domain of structural similarity or identity to a specific consensus sequence or the presence of a specific consensus DNA-binding site or DNA-binding site motif (see, for example, Riechmann et al., (2000) *Science* 290: 2105-2110). The plant transcription factors may belong to one of the following transcription factor families: the AP2 (APETALA2) domain transcription factor family (Riechmann and Meyerowitz (1998) *Biol. Chem.* 379:633-646); the MYB transcription factor family (Martin and Paz-Ares, (1997) *Trends Genet.* 13:67-73); the MADS domain transcription factor family (Riechmann and Meyerowitz (1997) *Biol. Chem.* 378:1079-1101); the WRKY protein family (Ishiguro and Nakamura (1994) *Mol. Gen. Genet.* 244:563-571); the ankyrin-repeat protein family (Zhang et al. (1992) *Plant Cell* 4:1575-1588); the zinc finger protein (Z) family (Klug and Schwabe (1995) *FASEB J.* 9: 597-604); the homeobox (HB) protein family (Buerglin in *Guidebook to the Homeobox Genes*, Duboule (ed.) (1994) Oxford University Press); the CAAT-element binding proteins (Forsburg and Guarente (1989) *Genes Dev.* 3:1166-1178); the squamosa promoter binding proteins (SPB) (Klein et al. (1996) *Mol. Gen. Genet.* 1996 250:7-16); the NAM protein family (Souer et al. (1996) *Cell* 85:159-170); the IAA/AUX proteins (Rouse et al. (1998) *Science* 279:1371-1373); the HLH/MYC protein family (Littlewood et al. (1994) *Prot. Profile* 1:639-709); the DNA-binding protein (DBP) family (Tucker et al. (1994) *EMBO J.* 13:2994-3002); the bZIP family of transcription factors (Foster et al. (1994) *FASEB J.* 8:192-200); the Box P-binding protein (the BPF-1) family (da Costa e Silva et al. (1993) *Plant J.* 4:125-135); the high mobility group (HMG) family (Bustin and Reeves (1996) *Prog. Nucl. Acids Res. Mol. Biol.* 54:35-100); the scarecrow (SCR) family (Di Laurenzio et al. (1996) *Cell* 86:423-433); the GF14 family (Wu et al. (1997) *Plant Physiol.* 114:1421-1431); the polycomb (PCOMB) family (Kennison (1995) *Annu. Rev. Genet.* 29:289-303); the teosinte branched (TEO) family (Luo et al. (1996) *Nature* 383:794-799; the ABI3 family (Giraudat et al. (1992) *Plant Cell* 4:1251-1261); the triple helix (TH) family (Dehesh et al. (1990) *Science* 250:1397-1399); the EIL family (Chao et al. (1997) *Cell* 89:1133-44); the AT-HOOK family (Reeves and Nissen (1990) *J. Biol. Chem.* 265:8573-8582); the S1FA family (Zhou et al. (1995) *Nucleic Acids Res.* 23:1165-1169); the bZIPT2 family (Lu and Ferl (1995) *Plant Physiol.* 109:723); the YABBY family (Bowman et al. (1999) *Development* 126: 2387-96); the PAZ family (Bohmert et al. (1998) *EMBO J.* 17:170-80); a family of miscellaneous (MISC) transcription factors including the DPBF family (Kim et al. (1997) *Plant J.* 11:1237-1251) and the SPF1 family (Ishiguro and Nakamura (1994) *Mol. Gen. Genet.* 244:563-571); the golden (GLD) family (Hall et al. (1998) *Plant Cell* 10:925-936), the TUBBY family (Boggin et al, (1999) *Science* 286:2119-2125), the heat shock family (Wu C (1995) *Annu Rev Cell Dev Biol* 11:441-469), the ENBP family (Christiansen et al (1996) *Plant Mol Biol* 32:809-821), the RING-zinc family (Jensen et al. (1998) *FEBS letters* 436:283-287), the PDBP family (Janik et al *Virology.* (1989) 168:320-329), the PCF family (Cubas P, et al. *Plant J.* (1999) 18:215-22), the SRS(SHI-related) family (Fridborg et al *Plant Cell* (1999) 11:1019-1032), the CPP (cysteine-rich polycomb-like) family (Cvitanich et al *Proc. Natl. Acad. Sci. USA.* (2000) 97:8163-8168), the ARF (auxin response factor) family (Ulmasov, et al. (1999) *Proc. Natl. Acad. Sci. USA* 96: 5844-5849), the SWI/SNF family (Collingwood et al *J. Mol. End.* 23:255-275), the ACBF family (Seguin et al (1997) *Plant Mol Biol.* 35:281-291), PCGL (CG-1 like) family (da Costa e Silva et al. (1994) *Plant Mol Biol.* 25:921-924) the ARID family (Vazquez et al. (1999) *Development.* 126: 733-42), the Jumonji family, Balciunas et al (2000, *Trends Biochem Sci.* 25: 274-276), the bZIP-NIN family (Schauser et al (1999) *Nature* 402: 191-195), the E2F family Kaelin et al (1992) *Cell* 70: 351-364) and the GRF-like family (Knaap et al (2000) *Plant Physiol.* 122: 695-704). As indicated by any part of the list above and as known in the art, transcription factors have been sometimes categorized by class, family, and sub-family according to their structural content and consensus DNA-binding site motif, for example. Many of the classes and many of the families and sub-families are listed here. However, the inclusion of one sub-family and not another, or the inclusion of one family and not another, does not mean that the invention does not encompass polynucleotides or polypeptides of a certain family or sub-family. The list provided here is merely an example of the types of transcription factors and the knowledge available concerning the consensus sequences and consensus DNA-binding site motifs that help define them as known to those of skill in the art (each of the references noted above are specifically incorporated herein by reference). A transcription factor may include, but is not limited to, any polypeptide that can activate or repress transcription of a single gene or a number of genes. This polypeptide group includes, but is not limited to, DNA-binding proteins, DNA-binding protein binding proteins, protein kinases, protein phosphatases, GTP-binding proteins, and receptors, and the like.

In addition to methods for modifying a plant phenotype by employing one or more polynucleotides and polypeptides of the invention described herein, the polynucleotides and polypeptides of the invention have a variety of additional uses. These uses include their use in the recombinant production (i.e., expression) of proteins; as regulators of plant gene expression, as diagnostic probes for the presence of complementary or partially complementary nucleic acids (including for detection of natural coding nucleic acids); as substrates for further reactions, e.g., mutation reactions, PCR reactions, or the like; as substrates for cloning e.g., including digestion or ligation reactions; and for identifying exogenous or endogenous modulators of the transcription factors. A "polynucleotide" is a nucleic acid sequence comprising a plurality of polymerized nucleotides, e.g., at least about 15 consecutive polymerized nucleotides, optionally at least about 30 consecutive nucleotides, at least about 50 consecutive nucleotides. In many instances, a polynucleotide comprises a nucleotide sequence encoding a polypeptide (or protein) or a domain or fragment thereof. Additionally, the polynucleotide may comprise a promoter, an intron, an enhancer region, a polyadenylation site, a translation initiation site, 5' or 3' untranslated regions, a reporter gene, a selectable marker, or the like. The polynucleotide can be single stranded or double stranded DNA or RNA. The polynucleotide optionally comprises modified bases or a modified backbone. The polynucleotide can be, e.g., genomic DNA or RNA, a transcript (such as an mRNA), a cDNA, a PCR product, a cloned DNA, a synthetic DNA or RNA, or the like. The polynucleotide can comprise a sequence in either sense or antisense orientations.

A "recombinant polynucleotide" is a polynucleotide that is not in its native state, e.g., the polynucleotide comprises a nucleotide sequence not found in nature, or the polynucleotide is in a context other than that in which it is naturally found, e.g., separated from nucleotide sequences with which it typically is in proximity in nature, or adjacent (or contiguous with) nucleotide sequences with which it typically is not in proximity. For example, the sequence at issue can be cloned into a vector, or otherwise recombined with one or more additional nucleic acid.

An "isolated polynucleotide" is a polynucleotide whether naturally occurring or recombinant, that is present outside the cell in which it is typically found in nature, whether purified or not. Optionally, an isolated polynucleotide is subject to one or more enrichment or purification procedures, e.g., cell lysis, extraction, centrifugation, precipitation, or the like.

A "polypeptide" is an amino acid sequence comprising a plurality of consecutive polymerized amino acid residues e.g., at least about 15 consecutive polymerized amino acid residues, optionally at least about 30 consecutive polymerized amino acid residues, at least about 50 consecutive polymerized amino acid residues. In many instances, a polypeptide comprises a polymerized amino acid residue sequence that is a transcription factor or a domain or portion or fragment thereof. Additionally, the polypeptide may comprise a localization domain, 2) an activation domain, 3) a repression domain, 4) an oligomerization domain or 5) a DNA-binding domain, or the like. The polypeptide optionally comprises modified amino acid residues, naturally occurring amino acid residues not encoded by a codon, non-naturally occurring amino acid residues.

A "recombinant polypeptide" is a polypeptide produced by translation of a recombinant polynucleotide. A "synthetic polypeptide" is a polypeptide created by consecutive polymerization of isolated amino acid residues using methods well known in the art. An "isolated polypeptide," whether a naturally occurring or a recombinant polypeptide, is more enriched in (or out of) a cell than the polypeptide in its natural state in a wild type cell, e.g., more than about 5% enriched, more than about 10% enriched, or more than about 20%, or more than about 50%, or more, enriched, i.e., alternatively denoted: 105%, 110%, 120%, 150% or more, enriched relative to wild type standardized at 100%. Such an enrichment is not the result of a natural response of a wild type plant. Alternatively, or additionally, the isolated polypeptide is separated from other cellular components with which it is typically associated, e.g., by any of the various protein purification methods herein.

"Identity" or "similarity" refers to sequence similarity between two polynucleotide sequences or between two polypeptide sequences, with identity being a more strict comparison. The phrases "percent identity" and "% identity" refer to the percentage of sequence similarity found in a comparison of two or more polynucleotide sequences or two or more polypeptide sequences. Identity or similarity can be determined by comparing a position in each sequence that may be aligned for purposes of comparison. When a position in the compared sequence is occupied by the same nucleotide base or amino acid, then the molecules are identical at that position. A degree of similarity or identity between polynucleotide sequences is a function of the number of identical or matching nucleotides at positions shared by the polynucleotide sequences. A degree of identity of polypeptide sequences is a function of the number of identical amino acids at positions shared by the polypeptide sequences. A degree of homology or similarity of polypeptide sequences is a function of the number of amino acids, i.e., structurally related, at positions shared by the polypeptide sequences.

"Altered" nucleic acid sequences encoding polypeptide include those sequences with deletions, insertions, or substitutions of different nucleotides, resulting in a polynucleotide encoding a polypeptide with at least one functional characteristic of the polypeptide. Included within this definition are polymorphisms that may or may not be readily detectable using a particular oligonucleotide probe of the polynucleotide encoding polypeptide, and improper or unexpected hybridization to allelic variants, with a locus other than the normal chromosomal locus for the polynucleotide sequence encoding polypeptide. The encoded polypeptide protein may also be "altered", and may contain deletions, insertions, or substitutions of amino acid residues that produce a silent change and result in a functionally equivalent polypeptide. Deliberate amino acid substitutions may be made on the basis of similarity in residue side chain chemistry, including, but not limited to, polarity, charge, solubility, hydrophobicity, hydrophilicity, and/or the amphipathic nature of the residues, as long as the biological activity of polypeptide is retained. For example, negatively charged amino acids may include aspartic acid and glutamic acid, positively charged amino acids may include lysine and arginine, and amino acids with uncharged polar head groups having similar hydrophilicity values may include leucine, isoleucine, and valine; glycine and alanine; asparagine and glutamine; serine and threonine; and phenylalanine and tyrosine. Alignments between different polypeptide sequences may be used to calculate "percentage sequence similarity".

The term "plant" includes whole plants, shoot vegetative organs/structures (e.g., leaves, stems and tubers), roots, flowers and floral organs/structures (e.g., bracts, sepals, petals, stamens, carpels, anthers and ovules), seed (including embryo, endosperm, and seed coat) and fruit (the mature ovary), plant tissue (e.g., vascular tissue, ground tissue, and the like) and cells (e.g., guard cells, egg cells, and the like), and progeny of same. The class of plants that can be used in the method of the invention is generally as broad as the class of higher and lower plants amenable to transformation techniques, including angiosperms (monocotyledonous and dicotyledonous plants), gymnosperms, ferns, horsetails, psilophytes, lycophytes, bryophytes, and multicellular algae. (See for example, FIG. 1, adapted from Daly et al. 2001 *Plant Physiology* 127:1328-1333; and see also Tudge, C., *The Variety of Life*, Oxford University Press, New York, 2000, pp. 547-606.)

A "transgenic plant" refers to a plant that contains genetic material not found in a wild type plant of the same species, variety or cultivar. The genetic material may include a transgene, an insertional mutagenesis event (such as by transposon or T-DNA insertional mutagenesis), an activation tagging sequence, a mutated sequence, a homologous recombination event or a sequence modified by chimeraplasty. Typically, the foreign genetic material has been introduced into the plant by human manipulation, but any method can be used as one of skill in the art recognizes.

A transgenic plant may contain an expression vector or cassette. The expression cassette typically comprises a polypeptide-encoding sequence operably linked (i.e., under regulatory control of) to appropriate inducible or constitutive regulatory sequences that allow for the expression of polypeptide. The expression cassette can be introduced into a plant by transformation or by breeding after transformation of a parent plant. A plant refers to a whole plant as well as to a plant part, such as seed, fruit, leaf, or root, plant tissue, plant cells or any other plant material, e.g., a plant explant, as well as to progeny thereof, and to in vitro systems that mimic biochemical or cellular components or processes in a cell.

"Ectopic expression or altered expression" in reference to a polynucleotide indicates that the pattern of expression in, e.g., a transgenic plant or plant tissue, is different from the expression pattern in a wild type plant or a reference plant of the same species. The pattern of expression may also be compared with a reference expression pattern in a wild type plant of the same species. For example, the polynucleotide or polypeptide is expressed in a cell or tissue type other than a cell or tissue type in which the sequence is expressed in the wild type plant, or by expression at a time other than at the time the sequence is expressed in the wild type plant, or by a response to different inducible agents, such as hormones or environmental signals, or at different expression levels (either higher or lower) compared with those found in a wild type plant. The term also refers to altered expression patterns that are produced by lowering the levels of expression to below the detection level or completely abolishing expression. The resulting expression pattern can be transient or stable, constitutive or inducible. In reference to a polypeptide, the term "ectopic expression or altered expression" further may relate to altered activity levels resulting from the interactions of the polypeptides with exogenous or endogenous modulators or from interactions with factors or as a result of the chemical modification of the polypeptides.

A "fragment" or "domain," with respect to a polypeptide, refers to a subsequence of the polypeptide. In some cases, the fragment or domain is a subsequence of the polypeptide which performs at least one biological function of the intact polypeptide in substantially the same manner, or to a similar extent, as does the intact polypeptide. For example, a polypeptide fragment can comprise a recognizable structural motif or functional domain such as a DNA-binding site or domain that binds to a DNA promoter region, an activation domain, or a domain for protein-protein interactions. Fragments can vary in size from as few as 6 amino acids to the full length of the intact polypeptide, but are preferably at least about 30 amino acids in length and more preferably at least about 60 amino acids in length. In reference to a polynucleotide sequence, "a fragment" refers to any subsequence of a polynucleotide, typically, of at least about 15 consecutive nucleotides, preferably at least about 30 nucleotides, more preferably at least about 50 nucleotides, of any of the sequences provided herein.

The invention also encompasses production of DNA sequences that encode transcription factors and transcription factor derivatives, or fragments thereof, entirely by synthetic chemistry. After production, the synthetic sequence may be inserted into any of the many available expression vectors and cell systems using reagents well known in the art. Moreover, synthetic chemistry may be used to introduce mutations into a sequence encoding transcription factors or any fragment thereof.

A "conserved domain", with respect to a polypeptide, refers to a domain within a transcription factor family which exhibits a higher degree of sequence homology, such as at least 65% sequence identity including conservative substitutions, and preferably at least 80% sequence identity, and more preferably at least 85%, or at least about 86%, or at least about 87%, or at least about 88%, or at least about 90%, or at least about 95%, or at least about 98% amino acid residue sequence identity of a polypeptide of consecutive amino acid residues. A fragment or domain can be referred to as outside a consensus sequence or outside a consensus DNA-binding site that is known to exist or that exists for a particular transcription factor class, family, or sub-family. In this case, the fragment or domain will not include the exact amino acids of a consensus sequence or consensus DNA-binding site of a transcription factor class, family or sub-family, or the exact amino acids of a particular transcription factor consensus sequence or consensus DNA-binding site. Furthermore, a particular fragment, region, or domain of a polypeptide, or a polynucleotide encoding a polypeptide, can be "outside a conserved domain" if all the amino acids of the fragment, region, or domain fall outside of a defined conserved domain(s) for a polypeptide or protein. The conserved domains for each of polypeptides of SEQ ID NOs:2-2N, where N=2-561, are listed in Table 5 as described in Example VII. Also, many of the polypeptides of Table 5 have conserved domains specifically indicated by start and stop sites. A comparison of the regions of the polypeptides in SEQ ID NOs:2-2N, where N=2-561, or of those in Table 5, allows one of skill in the art to identify conserved domain(s) for any of the polypeptides listed or referred to in this disclosure, including those in Table 5.

A "trait" refers to a physiological, morphological, biochemical, or physical characteristic of a plant or particular plant material or cell. In some instances, this characteristic is visible to the human eye, such as seed or plant size, or can be measured by biochemical techniques, such as detecting the protein, starch, or oil content of seed or leaves, or by observation of a metabolic or physiological process, e.g. by measuring uptake of carbon dioxide, or by the observation of the expression level of a gene or genes, e.g., by employing Northern analysis, RT-PCR, microarray gene expression assays, or reporter gene expression systems, or by agricultural observations such as stress tolerance, yield, or pathogen tolerance. Any technique can be used to measure the amount of, comparative level of, or difference in any selected chemical compound or macromolecule in the transgenic plants, however.

"Trait modification" refers to a detectable difference in a characteristic in a plant ectopically expressing a polynucleotide or polypeptide of the present invention relative to a plant not doing so, such as a wild type plant. In some cases, the trait modification can be evaluated quantitatively. For example, the trait modification can entail at least about a 2% increase or decrease in an observed trait (difference), at least a 5% difference, at least about a 10% difference, at least about a 20% difference, at least about a 30%, at least about a 50%, at least about a 70%, or at least about a 100%, or an even greater difference compared with a wild type plant. It is known that there can be a natural variation in the modified trait. Therefore, the trait modification observed entails a change of the normal distribution of the trait in the plants compared with the distribution observed in wild type plant.

I. Traits which May be Modified

Trait modifications of particular interest include those to seed (such as embryo or endosperm), fruit, root, flower, leaf, stem, shoot, seedling or the like, including: enhanced tolerance to environmental conditions including freezing, chilling, heat, drought, water saturation, radiation and ozone; improved tolerance to microbial, fungal or viral diseases; improved tolerance to pest infestations, including nematodes, mollicutes, parasitic higher plants or the like; decreased herbicide sensitivity; improved tolerance of heavy metals or enhanced ability to take up heavy metals; improved growth under poor photoconditions (e.g., low light and/or short day length), or changes in expression levels of genes of interest. Other phenotype that can be modified relate to the production of plant metabolites, such as variations in the production of taxol, tocopherol, tocotrienol, sterols, phytosterols, vitamins, wax monomers, anti-oxidants, amino acids, lignins, cellulose, tannins, prenyllipids (such as chlorophylls and carotenoids), glucosinolates, and terpenoids, enhanced or compositionally altered protein or oil production (especially in seeds), or modified sugar (insoluble or soluble) and/or starch composition. Physical plant characteristics that can be modified include cell development (such as the number of trichomes), fruit and seed size and number, yields of plant parts such as stems, leaves, inflorescences, and roots, the stability of the seeds during storage, characteristics of the seed pod (e.g., susceptibility to shattering), root hair length and quantity, internode distances, or the quality of seed coat. Plant growth characteristics that can be modified include growth rate, germination rate of seeds, vigor of plants and seedlings, leaf and flower senescence, male sterility, apomixis, flowering time, flower abscission, rate of nitrogen uptake, osmotic sensitivity to soluble sugar concentrations, biomass or transpiration characteristics, as well as plant architecture characteristics such as apical dominance, branching patterns, number of organs, organ identity, organ shape or size.

II. Transcription Factors Modify Expression of Endogenous Genes

Expression of genes which encode transcription factors that modify expression of endogenous genes, polynucleotides, and proteins are well known in the art. In addition, transgenic plants comprising isolated polynucleotides encoding transcription factors may also modify expression of endogenous genes, polynucleotides, and proteins. Examples include Peng et al. (1997, Genes and Development 11:3194-3205) and Peng et al. (1999, Nature, 400:256-261). In addition, many others have demonstrated that an *Arabidopsis* transcription factor expressed in an exogenous plant species elicits the same or very similar phenotypic response. See, for example, Fu et al. (2001, Plant Cell 13:1791-1802); Nandi et al. (2000, Curr. Biol. 10:215-218); Coupland (1995, Nature 377:482-483); and Weigel and Nilsson (1995, Nature 377: 482-500).

In another example, Mandel et al. (1992, Cell 71-133-143) and Suzuki et al. (2001, Plant J. 28:409-418) teach that a transcription factor expressed in another plant species elicits the same or very similar phenotypic response of the endogenous sequence, as often predicted in earlier studies of *Arabidopsis* transcription factors in *Arabidopsis* (see Mandel et al., 1992, supra; Suzuki et al., 2001, supra).

Other examples include Müller et al. (2001, Plant J. 28:169-179); Kim et al. (2001, Plant J. 25:247-259); Kyozuka and Shimamoto (2002, Plant Cell Physiol. 43:130-135); Boss and Thomas (2002, Nature, 416:847-850); He et al. (2000, Transgenic Res., 9:223-227); and Robson et al. (2001, Plant J. 28:619-631).

In yet another example, Gilmour et al. (1998, Plant J. 16:433-442) teach an *Arabidopsis* AP2 transcription factor, CBF1, which, when overexpressed in transgenic plants, increases plant freezing tolerance. Jaglo et al (2001, Plant Physiol. 127:910-017) further identified sequences in *Brassica napus* which encode CBF-like genes and that transcripts for these genes accumulated rapidly in response to low temperature. Transcripts encoding CBF-like proteins were also found to accumulate rapidly in response to low temperature in wheat, as well as in tomato. An alignment of the CBF proteins from *Arabidopsis*, *B. napus*, wheat, rye, and tomato revealed the presence of conserved amino acid sequences, PKK/RPAGRxKFxETRHP (SEQ ID NO: 1123) and DSAWR (SEQ ID NO: 1124), that bracket the AP2/EREBP DNA binding domains of the proteins and distinguish them from other members of the AP2/EREBP protein family. (See Jaglo et al., supra.)

III. Polypeptides and Polynucleotides of the Invention

The present invention provides, among other things, transcription factors (TFs), and transcription factor homologue polypeptides, and isolated or recombinant polynucleotides encoding the polypeptides, or novel variant polypeptides or polynucleotides encoding novel variants of transcription factors derived from the specific sequences provided here. These polypeptides and polynucleotides may be employed to modify a plant's characteristic.

Exemplary polynucleotides encoding the polypeptides of the invention were identified in the *Arabidopsis thaliana* GenBank database using publicly available sequence analysis programs and parameters. Sequences initially identified were then further characterized to identify sequences comprising specified sequence strings corresponding to sequence motifs present in families of known transcription factors. In addition, further exemplary polynucleotides encoding the polypeptides of the invention were identified in the plant GenBank database using publicly available sequence analysis programs and parameters. Sequences initially identified were then further characterized to identify sequences comprising specified sequence strings corresponding to sequence motifs present in families of known transcription factors. Polynucleotide sequences meeting such criteria were confirmed as transcription factors.

Additional polynucleotides of the invention were identified by screening *Arabidopsis thaliana* and/or other plant cDNA libraries with probes corresponding to known transcription factors under low stringency hybridization conditions. Additional sequences, including full length coding sequences were subsequently recovered by the rapid amplification of cDNA ends (RACE) procedure, using a commercially available kit according to the manufacturer's instructions. Where necessary, multiple rounds of RACE are performed to isolate 5' and 3' ends. The full length cDNA was then recovered by a routine end-to-end polymerase chain reaction (PCR) using primers specific to the isolated 5' and 3' ends. Exemplary sequences are provided in the Sequence Listing.

The polynucleotides of the invention can be or were ectopically expressed in overexpressor or knockout plants and the changes in the characteristic(s) or trait(s) of the plants observed. Therefore, the polynucleotides and polypeptides can be employed to improve the characteristics of plants.

The polynucleotides of the invention can be or were ectopically expressed in overexpressor plant cells and the changes in the expression levels of a number of genes, polynucleotides, and/or proteins of the plant cells observed. Therefore, the polynucleotides and polypeptides can be employed to change expression levels of a genes, polynucleotides, and/or proteins of plants.

IV. Producing Polypeptides

The polynucleotides of the invention include sequences that encode transcription factors and transcription factor homologue polypeptides and sequences complementary thereto, as well as unique fragments of coding sequence, or sequence complementary thereto. Such polynucleotides can be, e.g., DNA or RNA, e.g., mRNA, cRNA, synthetic RNA, genomic DNA, cDNA synthetic DNA, oligonucleotides, etc. The polynucleotides are either double-stranded or single-stranded, and include either, or both sense (i.e., coding) sequences and antisense (i.e., non-coding, complementary) sequences. The polynucleotides include the coding sequence of a transcription factor, or transcription factor homologue polypeptide, in isolation, in combination with additional coding sequences (e.g., a purification tag, a localization signal, as a fusion-protein, as a pre-protein, or the like), in combination with non-coding sequences (e.g., introns or inteins, regulatory elements such as promoters, enhancers, terminators, and the like), and/or in a vector or host environment in which the polynucleotide encoding a transcription factor or transcription factor homologue polypeptide is an endogenous or exogenous gene.

A variety of methods exist for producing the polynucleotides of the invention. Procedures for identifying and isolating DNA clones are well known to those of skill in the art, and are described in, e.g., Berger and Kimmel, *Guide to Molecular Cloning Techniques, Methods in Enzymology* volume 152 Academic Press, Inc., San Diego, Calif. ("Berger"); Sambrook et al., *Molecular Cloning—A Laboratory Manual* (2nd Ed.), Vol. 1-3, Cold Spring Harbor Laboratory, Cold Spring Harbor, N.Y., 1989 ("Sambrook") and *Current Protocols in*

*Molecular Biology*, F. M. Ausubel et al., eds., Current Protocols, a joint venture between Greene Publishing Associates, Inc. and John Wiley & Sons, Inc., (supplemented through 2000) ("Ausubel").

Alternatively, polynucleotides of the invention, can be produced by a variety of in vitro amplification methods adapted to the present invention by appropriate selection of specific or degenerate primers. Examples of protocols sufficient to direct persons of skill through in vitro amplification methods, including the polymerase chain reaction (PCR) the ligase chain reaction (LCR), Qbeta-replicase amplification and other RNA polymerase mediated techniques (e.g., NASBA), e.g., for the production of the homologous nucleic acids of the invention are found in Berger (supra), Sambrook (supra), and Ausubel (supra), as well as Mullis et al., (1987) *PCR Protocols A Guide to Methods and Applications* (Innis et al. eds) Academic Press Inc. San Diego, Calif. (1990) (Innis). Improved methods for cloning in vitro amplified nucleic acids are described in Wallace et al., U.S. Pat. No. 5,426,039. Improved methods for amplifying large nucleic acids by PCR are summarized in Cheng et al. (1994) *Nature* 369: 684-685 and the references cited therein, in which PCR amplicons of up to 40 kb are generated. One of skill will appreciate that essentially any RNA can be converted into a double stranded DNA suitable for restriction digestion, PCR expansion and sequencing using reverse transcriptase and a polymerase. See, e.g., Ausubel, Sambrook and Berger, all supra.

Alternatively, polynucleotides and oligonucleotides of the invention can be assembled from fragments produced by solid-phase synthesis methods. Typically, fragments of up to approximately 100 bases are individually synthesized and then enzymatically or chemically ligated to produce a desired sequence, e.g., a polynucleotide encoding all or part of a transcription factor. For example, chemical synthesis using the phosphoramidite method is described, e.g., by Beaucage et al. (1981) *Tetrahedron Letters* 22:1859-1869; and Matthes et al. (1984) *EMBO J.* 3:801-805. According to such methods, oligonucleotides are synthesized, purified, annealed to their complementary strand, ligated and then optionally cloned into suitable vectors. And if so desired, the polynucleotides and polypeptides of the invention can be custom ordered from any of a number of commercial suppliers.

V. Homologous Sequences

Sequences homologous, i.e., that share significant sequence identity or similarity, to those provided in the Sequence Listing, derived from *Arabidopsis thaliana* or from other plants of choice are also an aspect of the invention. Homologous sequences can be derived from any plant including monocots and dicots and in particular agriculturally important plant species, including but not limited to, crops such as soybean, wheat, corn, potato, cotton, rice, rape, oilseed rape (including canola), sunflower, alfalfa, sugarcane and turf; or fruits and vegetables, such as banana, blackberry, blueberry, strawberry, and raspberry, cantaloupe, carrot, cauliflower, coffee, cucumber, eggplant, grapes, honeydew, lettuce, mango, melon, onion, papaya, peas, peppers, pineapple, pumpkin, spinach, squash, sweet corn, tobacco, tomato, watermelon, rosaceous fruits (such as apple, peach, pear, cherry and plum) and vegetable brassicas (such as broccoli, cabbage, cauliflower, Brussels sprouts, and kohlrabi). Other crops, fruits and vegetables whose phenotype can be changed include barley, rye, millet, sorghum, currant, avocado, citrus fruits such as oranges, lemons, grapefruit and tangerines, artichoke, cherries, nuts such as the walnut and peanut, endive, leek, roots, such as arrowroot, beet, cassava, turnip, radish, yam, and sweet potato, and beans. The homologous sequences may also be derived from woody species, such pine, poplar and eucalyptus, or mint or other labiates.

Orthologs And Paralogs

Several different methods are known by those of skill in the art for identifying and defining these functionally homologous sequences. Three general methods for defining paralogs and orthologs are described; a paralog or ortholog or homolog may be identified by one or more of the methods described below.

Orthologs and paralogs are evolutionarily related genes that have similar sequence and similar functions. Orthologs are structurally related genes in different species that are derived from a speciation event. Paralogs are structurally related genes within a single species that are derived by a duplication event.

Within a single plant species, gene duplication may cause two copies of a particular gene, giving rise to two or more genes with similar sequence and similar function known as paralogs. A paralog is therefore a similar gene with a similar function within the same species. Paralogs typically cluster together or in the same Glade (a group of similar genes) when a gene family phylogeny is analyzed using programs such as CLUSTAL (Thompson et al. (1994) Nucleic Acids Res. 22:4673-4680; Higgins et al. (1996) Methods Enzymol. 266 383-402). Groups of similar genes can also be identified with pair-wise BLAST analysis (Feng and Doolittle (1987) J. Mol. Evol. 25:351-360). For example, a Glade of very similar MADS domain transcription factors from *Arabidopsis* all share a common function in flowering time (Ratcliffe et al. (2001) Plant Physiol. 126:122-132), and a group of very similar AP2 domain transcription factors from *Arabidopsis* are involved in tolerance of plants to freezing (Gilmour et al. (1998) Plant J. 16:433-442). Analysis of groups of similar genes with similar function that fall within one Glade can yield sub-sequences that are particular to the Glade. These sub-sequences, known as consensus sequences, can not only be used to define the sequences within each Glade, but define the functions of these genes; genes within a Glade may contain paralogous or orthologous sequences that share the same function. (See also, for example, Mount, D. W. (2001) *Bioinformatics: Sequence and Genome Analysis* Cold Spring Harbor Laboratory Press, Cold Spring Harbor, N.Y. page 543.)

Speciation, the production of new species from a parental species, can also give rise to two or more genes with similar sequence and similar function. These genes, termed orthologs, often have an identical function within their host plants and are often interchangeable between species without losing function. Because plants have common ancestors, many genes in any plant species will have a corresponding orthologous gene in another plant species. Once a phylogenic tree for a gene family of one species has been constructed using a program such as CLUSTAL (Thompson et al. (1994) Nucleic Acids Res. 22:4673-4680; Higgins et al. (1996) Methods Enzymol. 266:383-402), potential orthologous sequences can placed into the phylogenetic tree and its relationship to genes from the species of interest can be determined. Once the ortholog pair has been identified, the function of the test ortholog can be determined by determining the function of the reference ortholog.

Transcription factors that are homologous to the listed sequences will typically share at least about 30% amino acid sequence identity, or at least about 30% amino acid sequence identity outside of a known consensus sequence or consensus DNA-binding site. More closely related transcription factors can share at least about 50%, about 60%, about 65%, about 70%, about 75% or about 80% or about 90% or about 95% or about 98% or more sequence identity with the listed sequences, or with the listed sequences but excluding or outside a known consensus sequence or consensus DNA-binding site, or with the listed sequences excluding one or all conserved domain. Factors that are most closely related to the listed sequences share, e.g., at least about 85%, about 90% or about 95% or more % sequence identity to the listed sequences, or to the listed sequences but excluding or outside a known consensus sequence or consensus DNA-binding site or outside one or all conserved domain. At the nucleotide level, the sequences will typically share at least about 40% nucleotide sequence identity, preferably at least about 50%, about 60%, about 70% or about 80% sequence identity, and more preferably about 85%, about 90%, about 95% or about 97% or more sequence identity to one or more of the listed sequences, or to a listed sequence but excluding or outside a known consensus sequence or consensus DNA-binding site, or outside one or all conserved domain. The degeneracy of the genetic code enables major variations in the nucleotide sequence of a polynucleotide while maintaining the amino acid sequence of the encoded protein. Conserved domains within a transcription factor family may exhibit a higher degree of sequence homology, such as at least 65% sequence identity including conservative substitutions, and preferably at least 80% sequence identity, and more preferably at least 85%, or at least about 86%, or at least about 87%, or at least about 88%, or at least about 90%, or at least about 95%, or at least about 98% sequence identity. Transcription factors that are homologous to the listed sequences should share at least 30%, or at least about 60%, or at least about 75%, or at least 30%, or at least about 90%, or at least about 95% amino acid sequence identity over the entire length of the polypeptide or the homolog. In addition, transcription factors that are homologous to the listed sequences should share at least 30%, or at least about 60%, or at least about 75%, or at least about 80%, or at least about 90%, or at least about 95% amino acid sequence similarity over the entire length of the polypeptide or the homolog.

Percent identity can be determined electronically, e.g., by using the MEGALIGN program (DNASTAR, Inc. Madison, Wis.). The MEGALIGN program can create alignments between two or more sequences according to different methods, e.g., the clustal method. (See, e.g., Higgins, D. G. and P. M. Sharp (1988) Gene 73:237-244.) The clustal algorithm groups sequences into clusters by examining the distances between all pairs. The clusters are aligned pairwise and then in groups. Other alignment algorithms or programs may be used, including FASTA, BLAST, or ENTREZ, FASTA and BLAST. These are available as a part of the GCG sequence analysis package (University of Wisconsin, Madison, Wis.), and can be used with or without default settings. ENTREZ is available through the National Center for Biotechnology Information. In one embodiment, the percent identity of two sequences can be determined by the GCG program with a gap weight of 1, e.g., each amino acid gap is weighted as if it were a single amino acid or nucleotide mismatch between the two sequences (see U.S. Pat. No. 6,262,333).

Other techniques for alignment are described in Methods in Enzymology, vol. 266: Computer Methods for Macromolecular Sequence Analysis (1996), ed. Doolittle, Academic Press, Inc., San Diego, Calif., USA. Preferably, an alignment program that permits gaps in the sequence is utilized to align the sequences. The Smith-Waterman is one type of algorithm that permits gaps in sequence alignments. See Methods Mol. Biol. 70: 173-187 (1997). Also, the GAP program using the Needleman and Wunsch alignment method can be utilized to align sequences. An alternative search strategy uses MPSRCH software, which runs on a MASPAR computer. MPSRCH uses a Smith-Waterman algorithm to score sequences on a massively parallel computer. This approach improves ability to pick up distantly related matches, and is especially tolerant of small gaps and nucleotide sequence errors. Nucleic acid-encoded amino acid sequences can be used to search both protein and DNA databases.

The percentage similarity between two polypeptide sequences, e.g., sequence A and sequence B, is calculated by dividing the length of sequence A, minus the number of gap residues in sequence A, minus the number of gap residues in sequence B, into the sum of the residue matches between sequence A and sequence B, times one hundred. Gaps of low or of no similarity between the two amino acid sequences are not included in determining percentage similarity. Percent identity between polynucleotide sequences can also be counted or calculated by other methods known in the art, e.g., the Jotun Hein method. (See, e.g., Hein, J. (1990) Methods Enzymol. 183:626-645.) Identity between sequences can also be determined by other methods known in the art, e.g., by varying hybridization conditions (see US Patent Application No. 20010010913).

Thus, the invention provides methods for identifying a sequence similar or paralogous or orthologous or homologous to one or more polynucleotides as noted herein, or one or more target polypeptides encoded by the polynucleotides, or otherwise noted herein and may include linking or associating a given plant phenotype or gene function with a sequence. In the methods, a sequence database is provided (locally or across an inter or intra net) and a query is made against the sequence database using the relevant sequences herein and associated plant phenotypes or gene functions.

In addition, one or more polynucleotide sequences or one or more polypeptides encoded by the polynucleotide sequences may be used to search against a BLOCKS (Bairoch et al. (1997) Nucleic Acids Res. 25:217-221), PFAM, and other databases which contain previously identified and annotated motifs, sequences and gene functions. Methods that search for primary sequence patterns with secondary structure gap penalties (Smith et al. (1992) Protein Engineering 5:35-51) as well as algorithms such as Basic Local Alignment Search Tool (BLAST; Altschul, S. F. (1993) J. Mol. Evol. 36:290-300; Altschul et al. (1990) supra), BLOCKS (Henikoff, S, and Henikoff, G. J. (1991) Nucleic Acids Research 19:6565-6572), Hidden Markov Models (HMM; Eddy, S. R. (1996) Cur. Opin. Str. Biol. 6:361-365; Sonnhammer et al. (1997) Proteins 28:405-420), and the like, can be used to manipulate and analyze polynucleotide and polypeptide sequences encoded by polynucleotides. These databases, algorithms and other methods are well known in the art and are described in Ausubel et al. (1997; Short Protocols in Molecular Biology, John Wiley & Sons, New York N.Y., unit 7.7) and in Meyers, R. A. (1995; Molecular Biology and Biotechnology, Wiley VCH, New York N.Y., p 856-853).

Furthermore, methods using manual alignment of sequences similar or homologous to one or more polynucleotide sequences or one or more polypeptides encoded by the polynucleotide sequences may be used to identify regions of similarity and conserved domains. Such manual methods are well-known of those of skill in the art and can include, for example, comparisons of tertiary structure between a polypeptide sequence encoded by a polynucleotide which comprises a known function with a polypeptide sequence encoded by a polynucleotide sequence which has a function not yet determined Such examples of tertiary structure may comprise predicted alpha helices, beta-sheets, amphipathic helices, leucine zipper motifs, zinc finger motifs, proline-rich regions, cysteine repeat motifs, and the like.

VI. Identifying Polynucleotides or Nucleic Acids by Hybridization

Polynucleotides homologous to the sequences illustrated in the Sequence Listing and tables can be identified, e.g., by hybridization to each other under stringent or under highly stringent conditions. Single stranded polynucleotides hybridize when they associate based on a variety of well characterized physical-chemical forces, such as hydrogen bonding, solvent exclusion, base stacking and the like. The stringency of a hybridization reflects the degree of sequence identity of the nucleic acids involved, such that the higher the stringency, the more similar are the two polynucleotide strands. Stringency is influenced by a variety of factors, including temperature, salt concentration and composition, organic and non-organic additives, solvents, etc. present in both the hybridization and wash solutions and incubations (and number thereof), as described in more detail in the references cited above. Encompassed by the invention are polynucleotide sequences that are capable of hybridizing to the claimed polynucleotide sequences, and, in particular, to those shown in SEQ ID NOs: 860; 802; 240; 274; 558; 24; 1120; 44; 460; 286; 120; 130; 134; 698; 832; 580; 612; 48, and fragments thereof under various conditions of stringency. (See, e.g., Wahl, G. M. and S. L. Berger (1987) Methods Enzymol. 152:399-407; Kimmel, A. R. (1987) Methods Enzymol. 152: 507-511.) Estimates of homology are provided by either DNA-DNA or DNA-RNA hybridization under conditions of stringency as is well understood by those skilled in the art (Hames and Higgins, Eds. (1985) Nucleic Acid Hybridisation, IRL Press, Oxford, U.K.). Stringency conditions can be adjusted to screen for moderately similar fragments, such as homologous sequences from distantly related organisms, to highly similar fragments, such as genes that duplicate functional enzymes from closely related organisms. Post-hybridization washes determine stringency conditions.

In addition to the nucleotide sequences listed in Tables 4 and 5, full length cDNA, orthologs, paralogs and homologs of the present nucleotide sequences may be identified and isolated using well known methods. The cDNA libraries orthologs, paralogs and homologs of the present nucleotide sequences may be screened using hybridization methods to determine their utility as hybridization target or amplification probes.

An example of stringent hybridization conditions for hybridization of complementary nucleic acids which have more than 100 complementary residues on a filter in a Southern or northern blot is about 5° C. to 20° C. lower than the thermal melting point ($T_m$) for the specific sequence at a defined ionic strength and pH. The $T_m$ is the temperature (under defined ionic strength and pH) at which 50% of the target sequence hybridizes to a perfectly matched probe. Nucleic acid molecules that hybridize under stringent conditions will typically hybridize to a probe based on either the entire cDNA or selected portions, e.g., to a unique subsequence, of the cDNA under wash conditions of 0.2×SSC to 2.0×SSC, 0.1% SDS at 50-65° C. For example, high stringency is about 0.2×SSC, 0.1% SDS at 65° C. Ultra-high stringency will be the same conditions except the wash temperature is raised about 3 to about 5° C., and ultra-ultra-high stringency will be the same conditions except the wash temperature is raised about 6 to about 9° C. For identification of less closely related homologues washes can be performed at a lower temperature, e.g., 50° C. In general, stringency is increased by raising the wash temperature and/or decreasing the concentration of SSC, as known in the art.

In another example, stringent salt concentration will ordinarily be less than about 750 mM NaCl and 75 mM trisodium citrate, preferably less than about 500 mM NaCl and 50 mM trisodium citrate, and most preferably less than about 250 mM NaCl and 25 mM trisodium citrate. Low stringency hybridization can be obtained in the absence of organic solvent, e.g., formamide, while high stringency hybridization can be obtained in the presence of at least about 35% formamide, and most preferably at least about 50% formamide. Stringent temperature conditions will ordinarily include temperatures of at least about 30° C., more preferably of at least about 37° C., and most preferably of at least about 42° C. Varying additional parameters, such as hybridization time, the concentration of detergent, e.g., sodium dodecyl sulfate (SDS), and the inclusion or exclusion of carrier DNA, are well known to those skilled in the art. Various levels of stringency are accomplished by combining these various conditions as needed. In a preferred embodiment, hybridization will occur at 30° C. in 750 mM NaCl, 75 mM trisodium citrate, and 1% SDS. In a more preferred embodiment, hybridization will occur at 37° C. in 500 mM NaCl, 50 mM trisodium citrate, 1% SDS, 35% formamide, and 100 µg/ml denatured salmon sperm DNA (ssDNA). In a most preferred embodiment, hybridization will occur at 42° C. in 250 mM NaCl, 25 mM trisodium citrate, 1% SDS, 50% formamide, and 200 µg/ml ssDNA. Useful variations on these conditions will be readily apparent to those skilled in the art.

The washing steps that follow hybridization can also vary in stringency. Wash stringency conditions can be defined by salt concentration and by temperature. As above, wash stringency can be increased by decreasing salt concentration or by increasing temperature. For example, stringent salt concentration for the wash steps will preferably be less than about 30 mM NaCl and 3 mM trisodium citrate, and most preferably less than about 15 mM NaCl and 1.5 mM trisodium citrate. Stringent temperature conditions for the wash steps will ordinarily include temperature of at least about 25° C., more preferably of at least about 42° C. Another preferred set of highly stringent conditions uses two final washes in 0.1×SSC, 0.1% SDS at 65° C. The most preferred high stringency washes are of at least about 68° C. For example, in a preferred embodiment, wash steps will occur at 25° C. in 30 mM NaCl, 3 mM trisodium citrate, and 0.1% SDS. In a more preferred embodiment, wash steps will occur at 42° C. in 15 mM NaCl, 1.5 mM trisodium citrate, and 0.1% SDS. In a most preferred embodiment, the wash steps will occur at 68° C. in 15 mM NaCl, 1.5 mM trisodium citrate, and 0.1% SDS. Additional variations on these conditions will be readily apparent to those skilled in the art (see U.S. Patent Application No. 20010010913).

As another example, stringent conditions can be selected such that an oligonucleotide that is perfectly complementary to the coding oligonucleotide hybridizes to the coding oligonucleotide with at least about a 5-10× higher signal to noise ratio than the ratio for hybridization of the perfectly complementary oligonucleotide to a nucleic acid encoding a transcription factor known as of the filing date of the application. Conditions can be selected such that a higher signal to noise ratio is observed in the particular assay which is used, e.g., about 15×, 25×, 35×, 50× or more. Accordingly, the subject nucleic acid hybridizes to the unique coding oligonucleotide with at least a 2× higher signal to noise ratio as compared to hybridization of the coding oligonucleotide to a nucleic acid encoding known polypeptide. Again, higher signal to noise ratios can be selected, e.g., about 5×, 10×, 25×, 35×, 50× or more. The particular signal will depend on the label used in the relevant assay, e.g., a fluorescent label, a colorimetric label, a radioactive label, or the like.

Alternatively, transcription factor homolog polypeptides can be obtained by screening an expression library using antibodies specific for one or more transcription factors. With the provision herein of the disclosed transcription factor, and transcription factor homologue nucleic acid sequences, the encoded polypeptide(s) can be expressed and purified in a heterologous expression system (e.g., *E. coli*) and used to raise antibodies (monoclonal or polyclonal) specific for the polypeptide(s) in question. Antibodies can also be raised against synthetic peptides derived from transcription factor, or transcription factor homologue, amino acid sequences. Methods of raising antibodies are well known in the art and are described in Harlow and Lane (1988) *Antibodies: A Laboratory Manual*, Cold Spring Harbor Laboratory, New York. Such antibodies can then be used to screen an expression library produced from the plant from which it is desired to clone additional transcription factor homologues, using the methods described above. The selected cDNAs can be confirmed by sequencing and enzymatic activity.

VII. Sequence Variations

It will readily be appreciated by those of skill in the art, that any of a variety of polynucleotide sequences are capable of encoding the transcription factors and transcription factor homologue polypeptides of the invention. Due to the degeneracy of the genetic code, many different polynucleotides can encode identical and/or substantially similar polypeptides in addition to those sequences illustrated in the Sequence Listing. Nucleic acids having a sequence that differs from the sequences shown in the Sequence Listing, or complementary sequences, that encode functionally equivalent peptides (i.e., peptides having some degree of equivalent or similar biological activity) but differ in sequence from the sequence shown in the sequence listing due to degeneracy in the genetic code, are also within the scope of the invention.

Altered polynucleotide sequences encoding polypeptides include those sequences with deletions, insertions, or substitutions of different nucleotides, resulting in a polynucleotide encoding a polypeptide with at least one functional characteristic of the instant polypeptides. Included within this definition are polymorphisms which may or may not be readily detectable using a particular oligonucleotide probe of the polynucleotide encoding the instant polypeptides, and improper or unexpected hybridization to allelic variants, with a locus other than the normal chromosomal locus for the polynucleotide sequence encoding the instant polypeptides.

Allelic variant refers to any of two or more alternative forms of a gene occupying the same chromosomal locus. Allelic variation arises naturally through mutation, and may result in phenotypic polymorphism within populations. Gene mutations can be silent (i.e., no change in the encoded polypeptide) or may encode polypeptides having altered amino acid sequence. The term allelic variant is also used herein to denote a protein encoded by an allelic variant of a gene. Splice variant refers to alternative forms of RNA transcribed from a gene. Splice variation arises naturally through use of alternative splicing sites within a transcribed RNA molecule, or less commonly between separately transcribed RNA molecules, and may result in several mRNAs transcribed from the same gene. Splice variants may encode polypeptides having altered amino acid sequence. The term splice variant is also used herein to denote a protein encoded by a splice variant of an mRNA transcribed from a gene.

Those skilled in the art would recognize that G681, SEQ ID NO: 580, represents a single transcription factor; allelic variation and alternative splicing may be expected to occur. Allelic variants of SEQ ID NO: 579 can be cloned by probing cDNA or genomic libraries from different individual organisms according to standard procedures. Allelic variants of the DNA sequence shown in SEQ ID NO: 579, including those containing silent mutations and those in which mutations result in amino acid sequence changes, are within the scope of the present invention, as are proteins which are allelic variants of SEQ ID NO: 580. cDNAs generated from alternatively spliced mRNAs, which retain the properties of the transcription factor are included within the scope of the present invention, as are polypeptides encoded by such cDNAs and mRNAs. Allelic variants and splice variants of these sequences can be cloned by probing cDNA or genomic libraries from different individual organisms or tissues according to standard procedures known in the art (see U.S. Pat. No. 6,388,064).

For example, Table 1 illustrates, e.g., that the codons AGC, AGT, TCA, TCC, TCG, and TCT all encode the same amino acid: serine. Accordingly, at each position in the sequence where there is a codon encoding serine, any of the above trinucleotide sequences can be used without altering the encoded polypeptide.

TABLE 1

| Amino acid | | | Possible Codons |
|---|---|---|---|
| Alanine | Ala | A | GCA GCC GCG GCU |
| Cysteine | Cys | C | TGC TGT |
| Aspartic acid | Asp | D | GAC GAT |
| Glutamic acid | Glu | E | GAA GAG |
| Phenylalanine | Phe | F | TTC TTT |
| Glycine | Gly | G | GGA GGC GGG GGT |
| Histidine | His | H | CAC CAT |
| Isoleucine | Ile | I | ATA ATC ATT |
| Lysine | Lys | K | AAA AAG |
| Leucine | Leu | L | TTA TTG CTA CTC CTG CTT |
| Methionine | Met | M | ATG |
| Asparagine | Asn | N | AAC AAT |
| Proline | Pro | P | CCA CCC CCG CCT |
| Glutamine | Gln | Q | CAA CAG |
| Arginine | Arg | R | AGA AGG CGA CGC CGG CGT |
| Serine | Ser | S | AGC AGT TCA TCC TCG TCT |
| Threonine | Thr | T | ACA ACC ACG ACT |
| Valine | Val | V | GTA GTC GTG GTT |
| Tryptophan | Trp | W | TGG |
| Tyrosine | Tyr | Y | TAC TAT |

Sequence alterations that do not change the amino acid sequence encoded by the polynucleotide are termed "silent" variations. With the exception of the codons ATG and TGG, encoding methionine and tryptophan, respectively, any of the possible codons for the same amino acid can be substituted by a variety of techniques, e.g., site-directed mutagenesis, available in the art. Accordingly, any and all such variations of a sequence selected from the above table are a feature of the invention.

In addition to silent variations, other conservative variations that alter one, or a few amino acids in the encoded polypeptide, can be made without altering the function of the polypeptide, these conservative variants are, likewise, a feature of the invention.

For example, substitutions, deletions and insertions introduced into the sequences provided in the Sequence Listing are also envisioned by the invention. Such sequence modifications can be engineered into a sequence by site-directed mutagenesis (Wu (ed.) *Meth. Enzymol.* (1993) vol. 217, Academic Press) or the other methods noted below. Amino acid substitutions are typically of single residues; insertions usually will be on the order of about from 1 to 10 amino acid residues; and deletions will range about from 1 to 30 residues.

In preferred embodiments, deletions or insertions are made in adjacent pairs, e.g., a deletion of two residues or insertion of two residues. Substitutions, deletions, insertions or any combination thereof can be combined to arrive at a sequence. The mutations that are made in the polynucleotide encoding the transcription factor should not place the sequence out of reading frame and should not create complementary regions that could produce secondary mRNA structure. Preferably, the polypeptide encoded by the DNA performs the desired function.

Conservative substitutions are those in which at least one residue in the amino acid sequence has been removed and a different residue inserted in its place. Such substitutions generally are made in accordance with the Table 2 when it is desired to maintain the activity of the protein. Table 2 shows amino acids which can be substituted for an amino acid in a protein and which are typically regarded as conservative substitutions.

TABLE 2

| Residue | Conservative Substitutions |
|---|---|
| Ala | Ser |
| Arg | Lys |
| Asn | Gln; His |
| Asp | Glu |
| Gln | Asn |
| Cys | Ser |
| Glu | Asp |
| Gly | Pro |
| His | Asn; Gln |
| Ile | Leu, Val |
| Leu | Ile; Val |
| Lys | Arg; Gln |
| Met | Leu; Ile |
| Phe | Met; Leu; Tyr |
| Ser | Thr; Gly |
| Thr | Ser; Val |
| Trp | Tyr |
| Tyr | Trp; Phe |
| Val | Ile; Leu |

Similar substitutions are those in which at least one residue in the amino acid sequence has been removed and a different residue inserted in its place. Such substitutions generally are made in accordance with the Table 3 when it is desired to maintain the activity of the protein. Table 3 shows amino acids which can be substituted for an amino acid in a protein and which are typically regarded as structural and functional substitutions. For example, a residue in column 1 of Table 3 may be substituted with residue in column 2; in addition, a residue in column 2 of Table 3 may be substituted with the residue of column 1

TABLE 3

| Residue | Similar Substitutions |
|---|---|
| Ala | Ser; Thr; Gly; Val; Leu; Ile |
| Arg | Lys; His; Gly |
| Asn | Gln; His; Gly; Ser; Thr |
| Asp | Glu, Ser; Thr |
| Gln | Asn; Ala |
| Cys | Ser; Gly |
| Glu | Asp |
| Gly | Pro; Arg |
| His | Asn; Gln; Tyr; Phe; Lys; Arg |
| Ile | Ala; Leu; Val; Gly; Met |
| Leu | Ala; Ile; Val; Gly; Met |
| Lys | Arg; His; Gln; Gly; Pro |
| Met | Leu; Ile; Phe |

TABLE 3-continued

| Residue | Similar Substitutions |
|---|---|
| Phe | Met; Leu; Tyr; Trp; His; Val; Ala |
| Ser | Thr; Gly; Asp; Ala; Val; Ile; His |
| Thr | Ser; Val; Ala; Gly |
| Trp | Tyr; Phe; His |
| Tyr | Trp; Phe; His |
| Val | Ala; Ile; Leu; Gly; Thr; Ser; Glu |

Substitutions that are less conservative than those in Table 2 can be selected by picking residues that differ more significantly in their effect on maintaining (a) the structure of the polypeptide backbone in the area of the substitution, for example, as a sheet or helical conformation, (b) the charge or hydrophobicity of the molecule at the target site, or (c) the bulk of the side chain. The substitutions which in general are expected to produce the greatest changes in protein properties will be those in which (a) a hydrophilic residue, e.g., seryl or threonyl, is substituted for (or by) a hydrophobic residue, e.g., leucyl, isoleucyl, phenylalanyl, valyl or alanyl; (b) a cysteine or proline is substituted for (or by) any other residue; (c) a residue having an electropositive side chain, e.g., lysyl, arginyl, or histidyl, is substituted for (or by) an electronegative residue, e.g., glutamyl or aspartyl; or (d) a residue having a bulky side chain, e.g., phenylalanine, is substituted for (or by) one not having a side chain, e.g., glycine.

VIII. Further Modifying Sequences of the Invention Mutation/Forced Evolution

In addition to generating silent or conservative substitutions as noted, above, the present invention optionally includes methods of modifying the sequences of the Sequence Listing. In the methods, nucleic acid or protein modification methods are used to alter the given sequences to produce new sequences and/or to modify chemically or enzymatically given sequences to change the properties of the nucleic acids or proteins.

Thus, in one embodiment, given nucleic acid sequences are modified, e.g., according to standard mutagenesis or artificial evolution methods to produce modified sequences. The modified sequences may be created using purified natural polynucleotides isolated from any organism or may be synthesized from purified compositions and chemicals using chemical means well know to those of skill in the art. For example, Ausubel, supra, provides additional details on mutagenesis methods. Artificial forced evolution methods are described, for example, by Stemmer (1994) *Nature* 370:389-391, Stemmer (1994) *Proc. Natl. Acad. Sci. USA* 91:10747-10751, and U.S. Pat. Nos. 5,811,238, 5,837,500, and 6,242,568. Methods for engineering synthetic transcription factors and other polypeptides are described, for example, by Zhang et al. (2000) *J. Biol. Chem.* 275:33850-33860, Liu et al. (2001) *J. Biol. Chem.* 276:11323-11334, and Isalan et al. (2001) *Nature Biotechnol.* 19:656-660. Many other mutation and evolution methods are also available and expected to be within the skill of the practitioner.

Similarly, chemical or enzymatic alteration of expressed nucleic acids and polypeptides can be performed by standard methods. For example, sequence can be modified by addition of lipids, sugars, peptides, organic or inorganic compounds, by the inclusion of modified nucleotides or amino acids, or the like. For example, protein modification techniques are illustrated in Ausubel, supra. Further details on chemical and enzymatic modifications can be found herein. These modification methods can be used to modify any given sequence, or to modify any sequence produced by the various mutation and artificial evolution modification methods noted herein.

Accordingly, the invention provides for modification of any given nucleic acid by mutation, evolution, chemical or enzymatic modification, or other available methods, as well as for the products produced by practicing such methods, e.g., using the sequences herein as a starting substrate for the various modification approaches.

For example, optimized coding sequence containing codons preferred by a particular prokaryotic or eukaryotic host can be used e.g., to increase the rate of translation or to produce recombinant RNA transcripts having desirable properties, such as a longer half-life, as compared with transcripts produced using a non-optimized sequence. Translation stop codons can also be modified to reflect host preference. For example, preferred stop codons for *Saccharomyces cerevisiae* and mammals are TAA and TGA, respectively. The preferred stop codon for monocotyledonous plants is TGA, whereas insects and *E. coli* prefer to use TAA as the stop codon.

The polynucleotide sequences of the present invention can also be engineered in order to alter a coding sequence for a variety of reasons, including but not limited to, alterations which modify the sequence to facilitate cloning, processing and/or expression of the gene product. For example, alterations are optionally introduced using techniques which are well known in the art, e.g., site-directed mutagenesis, to insert new restriction sites, to alter glycosylation patterns, to change codon preference, to introduce splice sites, etc.

Furthermore, a fragment or domain derived from any of the polypeptides of the invention can be combined with domains derived from other transcription factors or synthetic domains to modify the biological activity of a transcription factor. For instance, a DNA-binding domain derived from a transcription factor of the invention can be combined with the activation domain of another transcription factor or with a synthetic activation domain. A transcription activation domain assists in initiating transcription from a DNA-binding site. Examples include the transcription activation region of VP16 or GAL4 (Moore et al. (1998) *Proc. Natl. Acad. Sci. USA* 95: 376-381; and Aoyama et al. (1995) *Plant Cell* 7:1773-1785), peptides derived from bacterial sequences (Ma and Ptashne (1987) *Cell* 51; 113-119) and synthetic peptides (Giniger and Ptashne, (1987) *Nature* 330:670-672).

IX. Expression and Modification of Polypeptides

Typically, polynucleotide sequences of the invention are incorporated into recombinant DNA (or RNA) molecules that direct expression of polypeptides of the invention in appropriate host cells, transgenic plants, in vitro translation systems, or the like. Due to the inherent degeneracy of the genetic code, nucleic acid sequences which encode substantially the same or a functionally equivalent amino acid sequence can be substituted for any listed sequence to provide for cloning and expressing the relevant homologue.

X. Vectors, Promoters, and Expression Systems

The present invention includes recombinant constructs comprising one or more of the nucleic acid sequences herein. The constructs typically comprise a vector, such as a plasmid, a cosmid, a phage, a virus (e.g., a plant virus), a bacterial artificial chromosome (BAC), a yeast artificial chromosome (YAC), or the like, into which a nucleic acid sequence of the invention has been inserted, in a forward or reverse orientation. In a preferred aspect of this embodiment, the construct further comprises regulatory sequences, including, for example, a promoter, operably linked to the sequence. Large numbers of suitable vectors and promoters are known to those of skill in the art, and are commercially available.

General texts that describe molecular biological techniques useful herein, including the use and production of vectors, promoters and many other relevant topics, include Berger, Sambrook and Ausubel, supra. Any of the identified sequences can be incorporated into a cassette or vector, e.g., for expression in plants. A number of expression vectors suitable for stable transformation of plant cells or for the establishment of transgenic plants have been described including those described in Weissbach and Weissbach, (1989) *Methods for Plant Molecular Biology*, Academic Press, and Gelvin et al., (1990) *Plant Molecular Biology Manual*, Kluwer Academic Publishers. Specific examples include those derived from a Ti plasmid of *Agrobacterium tumefaciens*, as well as those disclosed by Herrera-Estrella et al. (1983) *Nature* 303: 209, Bevan (1984) *Nucl. Acid Res.* 12: 8711-8721, Klee (1985) *Bio/Technology* 3: 637-642, for dicotyledonous plants.

Alternatively, non-Ti vectors can be used to transfer the DNA into monocotyledonous plants and cells by using free DNA delivery techniques. Such methods can involve, for example, the use of liposomes, electroporation, microprojectile bombardment, silicon carbide whiskers, and viruses. By using these methods transgenic plants such as wheat, rice (Christou (1991) *Bio/Technology* 9: 957-962) and corn (Gordon-Kamm (1990) *Plant Cell* 2: 603-618) can be produced. An immature embryo can also be a good target tissue for monocots for direct DNA delivery techniques by using the particle gun (Weeks et al. (1993) *Plant Physiol* 102: 1077-1084; Vasil (1993) *Bio/Technology* 10: 667-674; Wan and Lemeaux (1994) *Plant Physiol* 104: 37-48, and for *Agrobacterium*-mediated DNA transfer (Ishida et al. (1996) *Nature Biotech* 14: 745-750).

Typically, plant transformation vectors include one or more cloned plant coding sequence (genomic or cDNA) under the transcriptional control of 5' and 3' regulatory sequences and a dominant selectable marker. Such plant transformation vectors typically also contain a promoter (e.g., a regulatory region controlling inducible or constitutive, environmentally- or developmentally-regulated, or cell- or tissue-specific expression), a transcription initiation start site, an RNA processing signal (such as intron splice sites), a transcription termination site, and/or a polyadenylation signal.

Examples of constitutive plant promoters which can be useful for expressing the TF sequence include: the cauliflower mosaic virus (CaMV) 35S promoter, which confers constitutive, high-level expression in most plant tissues (see, e.g., Odell et al. (1985) *Nature* 313:810-812); the nopaline synthase promoter (An et al. (1988) *Plant Physiol* 88:547-552); and the octopine synthase promoter (Fromm et al. (1989) *Plant Cell* 1: 977-984).

A variety of plant gene promoters that regulate gene expression in response to environmental, hormonal, chemical, developmental signals, and in a tissue-active manner can be used for expression of a TF sequence in plants. Choice of a promoter is based largely on the phenotype of interest and is determined by such factors as tissue (e.g., seed, fruit, root, pollen, vascular tissue, flower, carpel, etc.), inducibility (e.g., in response to wounding, heat, cold, drought, light, pathogens, etc.), timing, developmental stage, and the like. Numerous known promoters have been characterized and can favorably be employed to promote expression of a polynucleotide of the invention in a transgenic plant or cell of interest. For example, tissue specific promoters include: seed-specific promoters (such as the napin, phaseolin or DC3 promoter described in U.S. Pat. No. 5,773,697), fruit-specific promoters that are active during fruit ripening (such as the dru 1 promoter (U.S. Pat. No. 5,783,393), or the 2A11 promoter (U.S. Pat. No. 4,943,674) and the tomato polygalacturonase promoter (Bird et al. (1988) *Plant Mol Biol* 11:651), root-specific promoters, such as those disclosed in U.S. Pat. Nos. 5,618,988, 5,837,848 and 5,905,186, pollen-active promoters such as PTA29, PTA26 and PTA13 (U.S. Pat. No. 5,792,929), promoters active in vascular tissue (Ringli and Keller (1998) *Plant Mol Biol* 37:977-988), flower-specific (Kaiser et al, (1995) *Plant Mol Biol* 28:231-243), pollen (Baerson et al. (1994) *Plant Mol Biol* 26:1947-1959), carpels (Ohl et al. (1990) *Plant Cell* 2:837-848), pollen and ovules (Baerson et al. (1993) *Plant Mol Biol* 22:255-267), auxin-inducible promoters (such as that described in van der Kop et al. (1999) *Plant Mol Biol* 39:979-990 or Baumann et al. (1999) *Plant Cell* 11:323-334), cytokinin-inducible promoter (Guevara-Garcia (1998) *Plant Mol Biol* 38:743-753), promoters responsive to gibberellin (Shi et al. (1998) *Plant Mol Biol* 38:1053-1060, Willmott et al. (1998) 38:817-825) and the like. Additional promoters are those that elicit expression in response to heat (Ainley et al. (1993) *Plant Mol Biol* 22: 13-23), light (e.g., the pea rbcS-3A promoter, Kuhlemeier et al. (1989) *Plant Cell* 1:471, and the maize rbcS promoter, Schaffner and Sheen (1991) *Plant Cell* 3: 997); wounding (e.g., wunI, Siebertz et al. (1989) *Plant Cell* 1: 961); pathogens (such as the PR-1 promoter described in Buchel et al. (1999) *Plant Mol. Biol.* 40:387-396, and the PDF1.2 promoter described in Manners et al. (1998) *Plant Mol. Biol.* 38:1071-80), and chemicals such as methyl jasmonate or salicylic acid (Gatz et al. (1997) *Plant Mol Biol* 48: 89-108). In addition, the timing of the expression can be controlled by using promoters such as those acting at senescence (An and Amazon (1995) *Science* 270: 1986-1988); or late seed development (Odell et al. (1994) *Plant Physiol* 106:447-458).

Plant expression vectors can also include RNA processing signals that can be positioned within, upstream or downstream of the coding sequence. In addition, the expression vectors can include additional regulatory sequences from the 3'-untranslated region of plant genes, e.g., a 3' terminator region to increase mRNA stability of the mRNA, such as the PI-II terminator region of potato or the octopine or nopaline synthase 3' terminator regions.

Additional Expression Elements

Specific initiation signals can aid in efficient translation of coding sequences. These signals can include, e.g., the ATG initiation codon and adjacent sequences. In cases where a coding sequence, its initiation codon and upstream sequences are inserted into the appropriate expression vector, no additional translational control signals may be needed. However, in cases where only coding sequence (e.g., a mature protein coding sequence), or a portion thereof, is inserted, exogenous transcriptional control signals including the ATG initiation codon can be separately provided. The initiation codon is provided in the correct reading frame to facilitate transcription. Exogenous transcriptional elements and initiation codons can be of various origins, both natural and synthetic. The efficiency of expression can be enhanced by the inclusion of enhancers appropriate to the cell system in use.

Expression Hosts

The present invention also relates to host cells which are transduced with vectors of the invention, and the production of polypeptides of the invention (including fragments thereof) by recombinant techniques. Host cells are genetically engineered (i.e., nucleic acids are introduced, e.g., transduced, transformed or transfected) with the vectors of this invention, which may be, for example, a cloning vector or an expression vector comprising the relevant nucleic acids herein. The vector is optionally a plasmid, a viral particle, a phage, a naked nucleic acid, etc. The engineered host cells can be cultured in conventional nutrient media modified as appropriate for activating promoters, selecting transformants, or amplifying the relevant gene. The culture conditions, such as temperature, pH and the like, are those previously used with the host cell selected for expression, and will be apparent to those skilled in the art and in the references cited herein, including, Sambrook and Ausubel.

The host cell can be a eukaryotic cell, such as a yeast cell, or a plant cell, or the host cell can be a prokaryotic cell, such as a bacterial cell. Plant protoplasts are also suitable for some applications. For example, the DNA fragments are introduced into plant tissues, cultured plant cells or plant protoplasts by standard methods including electroporation (Fromm et al., (1985) *Proc. Natl. Acad. Sci. USA* 82, 5824, infection by viral vectors such as cauliflower mosaic virus (CaMV) (Hohn et al., (1982) *Molecular Biology of Plant Tumors*, (Academic Press, New York) pp. 549-560; U.S. Pat. No. 4,407,956), high velocity ballistic penetration by small particles with the nucleic acid either within the matrix of small beads or particles, or on the surface (Klein et al., (1987) *Nature* 327, 70-73), use of pollen as vector (WO 85/01856), or use of *Agrobacterium tumefaciens* or *A. rhizogenes* carrying a T-DNA plasmid in which DNA fragments are cloned. The T-DNA plasmid is transmitted to plant cells upon infection by *Agrobacterium tumefaciens*, and a portion is stably integrated into the plant genome (Horsch et al. (1984) *Science* 233:496-498; Fraley et al. (1983) *Proc. Natl. Acad. Sci. USA* 80, 4803).

The cell can include a nucleic acid of the invention which encodes a polypeptide, wherein the cells expresses a polypeptide of the invention. The cell can also include vector sequences, or the like. Furthermore, cells and transgenic plants that include any polypeptide or nucleic acid above or throughout this specification, e.g., produced by transduction of a vector of the invention, are an additional feature of the invention.

For long-term, high-yield production of recombinant proteins, stable expression can be used. Host cells transformed with a nucleotide sequence encoding a polypeptide of the invention are optionally cultured under conditions suitable for the expression and recovery of the encoded protein from cell culture. The protein or fragment thereof produced by a recombinant cell may be secreted, membrane-bound, or contained intracellularly, depending on the sequence and/or the vector used. As will be understood by those of skill in the art, expression vectors containing polynucleotides encoding mature proteins of the invention can be designed with signal sequences which direct secretion of the mature polypeptides through a prokaryotic or eukaryotic cell membrane.

XI. Modified Amino Acid Residues

Polypeptides of the invention may contain one or more modified amino acid residues. The presence of modified amino acids may be advantageous in, for example, increasing polypeptide half-life, reducing polypeptide antigenicity or toxicity, increasing polypeptide storage stability, or the like. Amino acid residue(s) are modified, for example, co-translationally or post-translationally during recombinant production or modified by synthetic or chemical means.

Non-limiting examples of a modified amino acid residue include incorporation or other use of acetylated amino acids, glycosylated amino acids, sulfated amino acids, prenylated (e.g., farnesylated, geranylgeranylated) amino acids, PEG modified (e.g., "PEGylated") amino acids, biotinylated amino acids, carboxylated amino acids, phosphorylated amino acids, etc. References adequate to guide one of skill in the modification of amino acid residues are replete throughout the literature.

The modified amino acid residues may prevent or increase affinity of the polypeptide for another molecule, including, but not limited to, polynucleotide, proteins, carbohydrates, lipids and lipid derivatives, and other organic or synthetic compounds.

XII. Identification of Additional Factors

A transcription factor provided by the present invention can also be used to identify additional endogenous or exogenous molecules that can affect a phenotype or trait of interest. On the one hand, such molecules include organic (small or large molecules) and/or inorganic compounds that affect expression of (i.e., regulate) a particular transcription factor. Alternatively, such molecules include endogenous molecules that are acted upon either at a transcriptional level by a transcription factor of the invention to modify a phenotype as desired. For example, the transcription factors can be employed to identify one or more downstream gene with which is subject to a regulatory effect of the transcription factor. In one approach, a transcription factor or transcription factor homologue of the invention is expressed in a host cell, e.g., a transgenic plant cell, tissue or explant, and expression products, either RNA or protein, of likely or random targets are monitored, e.g., by hybridization to a microarray of nucleic acid probes corresponding to genes expressed in a tissue or cell type of interest, by two-dimensional gel electrophoresis of protein products, or by any other method known in the art for assessing expression of gene products at the level of RNA or protein. Alternatively, a transcription factor of the invention can be used to identify promoter sequences (i.e., binding sites) involved in the regulation of a downstream target. After identifying a promoter sequence, interactions between the transcription factor and the promoter sequence can be modified by changing specific nucleotides in the promoter sequence or specific amino acids in the transcription factor that interact with the promoter sequence to alter a plant trait. Typically, transcription factor DNA-binding sites are identified by gel shift assays. After identifying the promoter regions, the promoter region sequences can be employed in double-stranded DNA arrays to identify molecules that affect the interactions of the transcription factors with their promoters (Bulyk et al. (1999) *Nature Biotechnology* 17:573-577).

The identified transcription factors are also useful to identify proteins that modify the activity of the transcription factor. Such modification can occur by covalent modification, such as by phosphorylation, or by protein-protein (homo or -heteropolymer) interactions. Any method suitable for detecting protein-protein interactions can be employed. Among the methods that can be employed are co-immunoprecipitation, cross-linking and co-purification through gradients or chromatographic columns, and the two-hybrid yeast system.

The two-hybrid system detects protein interactions in vivo and is described in Chien et al. ((1991), *Proc. Natl. Acad. Sci. USA* 88:9578-9582) and is commercially available from Clontech (Palo Alto, Calif.). In such a system, plasmids are constructed that encode two hybrid proteins: one consists of the DNA-binding domain of a transcription activator protein fused to the TF polypeptide and the other consists of the transcription activator protein's activation domain fused to an unknown protein that is encoded by a cDNA that has been recombined into the plasmid as part of a cDNA library. The DNA-binding domain fusion plasmid and the cDNA library are transformed into a strain of the yeast *Saccharomyces cerevisiae* that contains a reporter gene (e.g., lacZ) whose regulatory region contains the transcription activator's binding site. Either hybrid protein alone cannot activate transcription of the reporter gene. Interaction of the two hybrid proteins reconstitutes the functional activator protein and results in expression of the reporter gene, which is detected by an assay for the reporter gene product. Then, the library plasmids responsible for reporter gene expression are isolated and sequenced to identify the proteins encoded by the library plasmids. After identifying proteins that interact with the transcription factors, assays for compounds that interfere with the TF protein-protein interactions can be preformed.

XIII. Identification of Modulators

In addition to the intracellular molecules described above, extracellular molecules that alter activity or expression of a transcription factor, either directly or indirectly, can be identified. For example, the methods can entail first placing a candidate molecule in contact with a plant or plant cell. The molecule can be introduced by topical administration, such as spraying or soaking of a plant, and then the molecule's effect on the expression or activity of the TF polypeptide or the expression of the polynucleotide monitored. Changes in the expression of the TF polypeptide can be monitored by use of polyclonal or monoclonal antibodies, gel electrophoresis or the like. Changes in the expression of the corresponding polynucleotide sequence can be detected by use of microarrays, Northern blots, quantitative PCR, or any other technique for monitoring changes in mRNA expression. These techniques are exemplified in Ausubel et al. (eds) *Current Protocols in Molecular Biology*, John Wiley & Sons (1998, and supplements through 2001). Such changes in the expression levels can be correlated with modified plant traits and thus identified molecules can be useful for soaking or spraying on fruit, vegetable and grain crops to modify traits in plants.

Essentially any available composition can be tested for modulatory activity of expression or activity of any nucleic acid or polypeptide herein. Thus, available libraries of compounds such as chemicals, polypeptides, nucleic acids and the like can be tested for modulatory activity. Often, potential modulator compounds can be dissolved in aqueous or organic (e.g., DMSO-based) solutions for easy delivery to the cell or plant of interest in which the activity of the modulator is to be tested. Optionally, the assays are designed to screen large modulator composition libraries by automating the assay steps and providing compounds from any convenient source to assays, which are typically run in parallel (e.g., in microtiter formats on microtiter plates in robotic assays).

In one embodiment, high throughput screening methods involve providing a combinatorial library containing a large number of potential compounds (potential modulator compounds). Such "combinatorial chemical libraries" are then screened in one or more assays, as described herein, to identify those library members (particular chemical species or subclasses) that display a desired characteristic activity. The compounds thus identified can serve as target compounds.

A combinatorial chemical library can be, e.g., a collection of diverse chemical compounds generated by chemical synthesis or biological synthesis. For example, a combinatorial chemical library such as a polypeptide library is formed by combining a set of chemical building blocks (e.g., in one example, amino acids) in every possible way for a given compound length (i.e., the number of amino acids in a polypeptide compound of a set length). Exemplary libraries include peptide libraries, nucleic acid libraries, antibody libraries (see, e.g., Vaughn et al. (1996) *Nature Biotechnology*, 14(3):309-314 and PCT/US96/10287), carbohydrate libraries (see, e.g., Liang et al. *Science* (1996) 274:1520-1522 and U.S. Pat. No. 5,593,853), peptide nucleic acid libraries (see, e.g., U.S. Pat. No. 5,539,083), and small organic molecule libraries (see, e.g., benzodiazepines, Baum *C&EN* January 18, page 33 (1993); isoprenoids, U.S. Pat. No. 5,569,588; thiazolidinones and metathiazanones, U.S. Pat. No.

5,549,974; pyrrolidines, U.S. Pat. Nos. 5,525,735 and 5,519,134; morpholino compounds, U.S. Pat. No. 5,506,337) and the like.

Preparation and screening of combinatorial or other libraries is well known to those of skill in the art. Such combinatorial chemical libraries include, but are not limited to, peptide libraries (see, e.g., U.S. Pat. No. 5,010,175; Furka, (1991) *Int. J. Pept. Prot. Res.* 37:487-493; and Houghton et al. (1991) *Nature* 354:84-88). Other chemistries for generating chemical diversity libraries can also be used.

In addition, as noted, compound screening equipment for high-throughput screening is generally available, e.g., using any of a number of well known robotic systems that have also been developed for solution phase chemistries useful in assay systems. These systems include automated workstations including an automated synthesis apparatus and robotic systems utilizing robotic arms. Any of the above devices are suitable for use with the present invention, e.g., for high-throughput screening of potential modulators. The nature and implementation of modifications to these devices (if any) so that they can operate as discussed herein will be apparent to persons skilled in the relevant art.

Indeed, entire high throughput screening systems are commercially available. These systems typically automate entire procedures including all sample and reagent pipetting, liquid dispensing, timed incubations, and final readings of the microplate in detector(s) appropriate for the assay. These configurable systems provide high throughput and rapid start up as well as a high degree of flexibility and customization. Similarly, microfluidic implementations of screening are also commercially available.

The manufacturers of such systems provide detailed protocols the various high throughput. Thus, for example, Zymark Corp. provides technical bulletins describing screening systems for detecting the modulation of gene transcription, ligand binding, and the like. The integrated systems herein, in addition to providing for sequence alignment and, optionally, synthesis of relevant nucleic acids, can include such screening apparatus to identify modulators that have an effect on one or more polynucleotides or polypeptides according to the present invention.

In some assays it is desirable to have positive controls to ensure that the components of the assays are working properly. At least two types of positive controls are appropriate. That is, known transcriptional activators or inhibitors can be incubated with cells/plants/etc. in one sample of the assay, and the resulting increase/decrease in transcription can be detected by measuring the resulting increase in RNA/protein expression, etc., according to the methods herein. It will be appreciated that modulators can also be combined with transcriptional activators or inhibitors to find modulators that inhibit transcriptional activation or transcriptional repression. Either expression of the nucleic acids and proteins herein or any additional nucleic acids or proteins activated by the nucleic acids or proteins herein, or both, can be monitored.

In an embodiment, the invention provides a method for identifying compositions that modulate the activity or expression of a polynucleotide or polypeptide of the invention. For example, a test compound, whether a small or large molecule, is placed in contact with a cell, plant (or plant tissue or explant), or composition comprising the polynucleotide or polypeptide of interest and a resulting effect on the cell, plant, (or tissue or explant) or composition is evaluated by monitoring, either directly or indirectly, one or more of: expression level of the polynucleotide or polypeptide, activity (or modulation of the activity) of the polynucleotide or polypeptide. In some cases, an alteration in a plant phenotype can be detected following contact of a plant (or plant cell, or tissue or explant) with the putative modulator, e.g., by modulation of expression or activity of a polynucleotide or polypeptide of the invention. Modulation of expression or activity of a polynucleotide or polypeptide of the invention may also be caused by molecular elements in a signal transduction second messenger pathway and such modulation can affect similar elements in the same or another signal transduction second messenger pathway.

XIV. Subsequences

Also contemplated are uses of polynucleotides, also referred to herein as oligonucleotides, typically having at least 12 bases, preferably at least 15, more preferably at least 20, 30, or 50 bases, which hybridize under at least highly stringent (or ultra-high stringent or ultra-ultra-high stringent conditions) conditions to a polynucleotide sequence described above. The polynucleotides may be used as probes, primers, sense and antisense agents, and the like, according to methods as noted supra.

Subsequences of the polynucleotides of the invention, including polynucleotide fragments and oligonucleotides are useful as nucleic acid probes and primers. An oligonucleotide suitable for use as a probe or primer is at least about 15 nucleotides in length, more often at least about 18 nucleotides, often at least about 21 nucleotides, frequently at least about 30 nucleotides, or about 40 nucleotides, or more in length. A nucleic acid probe is useful in hybridization protocols, e.g., to identify additional polypeptide homologues of the invention, including protocols for microarray experiments. Primers can be annealed to a complementary target DNA strand by nucleic acid hybridization to form a hybrid between the primer and the target DNA strand, and then extended along the target DNA strand by a DNA polymerase enzyme. Primer pairs can be used for amplification of a nucleic acid sequence, e.g., by the polymerase chain reaction (PCR) or other nucleic-acid amplification methods. See Sambrook and Ausubel, supra.

In addition, the invention includes an isolated or recombinant polypeptide including a subsequence of at least about 15 contiguous amino acids encoded by the recombinant or isolated polynucleotides of the invention. For example, such polypeptides, or domains or fragments thereof, can be used as immunogens, e.g., to produce antibodies specific for the polypeptide sequence, or as probes for detecting a sequence of interest. A subsequence can range in size from about 15 amino acids in length up to and including the full length of the polypeptide.

To be encompassed by the present invention, an expressed polypeptide which comprises such a polypeptide subsequence performs at least one biological function of the intact polypeptide in substantially the same manner, or to a similar extent, as does the intact polypeptide. For example, a polypeptide fragment can comprise a recognizable structural motif or functional domain such as a DNA binding domain that binds to a specific DNA promoter region, an activation domain or a domain for protein-protein interactions.

XV. Production of Transgenic Plants

Modification of Traits

The polynucleotides of the invention are favorably employed to produce transgenic plants with various traits, or characteristics, that have been modified in a desirable manner, e.g., to improve the seed characteristics of a plant. For example, alteration of expression levels or patterns (e.g., spatial or temporal expression patterns) of one or more of the transcription factors (or transcription factor homologues) of the invention, as compared with the levels of the same protein found in a wild type plant, can be used to modify a plant's traits. An illustrative example of trait modification, improved characteristics, by altering expression levels of a particular transcription factor is described further in the Examples and the Sequence Listing.

*Arabidopsis* as a model system. *Arabidopsis thaliana* is the object of rapidly growing attention as a model for genetics and metabolism in plants. *Arabidopsis* has a small genome, and well documented studies are available. It is easy to grow in large numbers and mutants defining important genetically controlled mechanisms are either available, or can readily be obtained. Various methods to introduce and express isolated homologous genes are available (see Koncz, et al., eds. *Methods in Arabidopsis Research*. et al. (1992), World Scientific, New Jersey, N.J., in "Preface"). Because of its small size, short life cycle, obligate autogamy and high fertility, *Arabidopsis* is also a choice organism for the isolation of mutants and studies in morphogenetic and development pathways, and control of these pathways by transcription factors (Koncz, supra, p. 72). A number of studies introducing transcription factors into *A. thaliana* have demonstrated the utility of this plant for understanding the mechanisms of gene regulation and trait alteration in plants. See, for example, Koncz, supra, and U.S. Pat. No. 6,417,428).

*Arabidopsis* genes in transgenic plants. Expression of genes which encode transcription factors modify expression of endogenous genes, polynucleotides, and proteins are well known in the art. In addition, transgenic plants comprising isolated polynucleotides encoding transcription factors may also modify expression of endogenous genes, polynucleotides, and proteins. Examples include Peng et al. (1997, Genes and Development 11:3194-3205) and Peng et al. (1999, Nature, 400:256-261). In addition, many others have demonstrated that an *Arabidopsis* transcription factor expressed in an exogenous plant species elicits the same or very similar phenotypic response. See, for example, Fu et al. (2001, Plant Cell 13:1791-1802); Nandi et al. (2000, Curr. Biol. 10:215-218); Coupland (1995, Nature 377:482-483); and Weigel and Nilsson (1995, Nature 377:482-500).

Homologous genes introduced into transgenic plants. Homologous genes that may be derived from any plant, or from any source whether natural, synthetic, semi-synthetic or recombinant, and that share significant sequence identity or similarity to those provided by the present invention, may be introduced into plants, for example, crop plants, to confer desirable or improved traits. Examples of non-Arabidopsis sequences homologous to *Arabidopsis* are listed in Table 4. Consequently, transgenic plants may be produced that comprise a recombinant expression vector or cassette with a promoter operably linked to one or more sequences homologous to presently disclosed sequences. The promoter may be, for example, a plant or viral promoter.

TABLE 4

Orthologs of *Arabidopsis* sequences

| SEQ ID NO | GID | Test Sequence ID | Smallest Sum Probability | Test Sequence Species | Test Sequence GenBank Annotation |
|---|---|---|---|---|---|
| 859 | G192 | AW596933 | 7.70E−40 | [*Glycine max*] | sj84107.y1 Gm-c1034 *Glycine max* cDNA clone GENOME SYSTEMS CLONE ID: Gm-c1034-1694 5 similar to TR:O04609 004609 SIMILAR TO SPF1 DNA-BINDING PROTEIN.;, mRNA sequence |
| 859 | G192 | AV423663 | 2.40E−39 | [*Lotus japonicus*] | AV423663 *Lotus japonicus* young plants (two-week old) *Lotus japonicus* cDNA clone MWM030d08_r 5-, mRNA sequence |
| 859 | G192 | BI422074 | 4.50E−34 | [*Lycopersicon esculentum*] | EST532740 tomato callus, TAMU *Lycopersicon esculentum* cDNA clone cLEC68N18 5' end, mRNA sequence |
| 859 | G192 | AW447931 | 1.40E−27 | [*Triticum aestivum*] | BRY_1082 BRY *Triticum aestivum* cDNA clone P20-1M, mRNA sequence |
| 859 | G192 | BE998060 | 2.60E−24 | [*Medicago truncatula*] | EST429783 GVSN *Medicago truncatula* cDNA clone pGVSN-8N15, mRNA sequence |
| 859 | G192 | AC018727 | 1.70E−23 | [*Oryza sativa*] | *Oryza sativa* chromosome 10 clone OSJNBa0056G17, *** SEQUENCING IN PROGRESS ***, 19 unordered pieces |
| 859 | G192 | BG600477 | 1.00E−20 | [*Solanum tuberosum*] | EST505372 cSTS *Solanum tuberosum* cDNA clone cSTS29K17 5- sequence, mRNA sequence |
| 859 | G192 | BG356878 | 2.80E−16 | [*Sorghum bicolor*] | OV2_11_B04.g1_A002 Ovary 2 (OV2) *Sorghum bicolor* cDNA, mRNA sequence |
| 859 | G192 | gi12039364 | 1.10E−31 | [*Oryza sativa*] | putative DNA-binding protein [*Oryza sativa* Japonica Group] |
| 859 | G192 | gi4894963 | 3.30E−14 | [*Avena sativa*] | DNA-binding protein WRKY3 [*Avena sativa*] |
| 859 | G192 | gi1432056 | 5.80E−14 | [*Petroselinum. cspum*] | WRKY3 [*Petroselinum crispum*] |
| 859 | G192 | gi4760596 | 2.60E−13 | [*Nicotiana tabacum*] | DNA-binding protein NtWRKY3 [*Nicotiana tabacum*] |
| 859 | G192 | gi11993901 | 1.40E−12 | [*Dactylis glomerata*] | somatic embryogenesis related protein [*Dactylis glomerata*] |
| 859 | G192 | gi927025 | 7.60E−09 | [*Cucumis sativus*] | SPF1-like DNA binding protein [*Cucumis sativus*] |
| 859 | G192 | gi13620227 | 8.40E−09 | [*Lycopersicon esculentum*] | hypothetical protein [*Lycopersicon esculentum*] |

TABLE 4-continued

Orthologs of *Arabidopsis* sequences

| SEQ ID NO | GID | Test Sequence ID | Smallest Sum Probability | Test Sequence Species | Test Sequence GenBank Annotation |
|---|---|---|---|---|---|
| 859 | G192 | gi3420906 | 2.80E−08 | [*Pimpinella brachycarpa*] | zinc finger protein; WRKY1 [*Pimpinella brachycarpa*] |
| 859 | G192 | gi1159877 | 4.70E−08 | [*Avena fatua*] | DNA-binding protein [*Avena fatua*] |
| 859 | G192 | gi484261 | 1.60E−07 | [*Ipomoea batatas*] | SPF1 protein [*Ipomoea batatas*] |
| 801 | G1946 | LPHSF8 (CAA47869) | 1.10E−119 | [*Lycopersicon peruvianum*] | L.peruvianum Lp-hsf8 mRNA for heat stress transcription factor 8 |
| 801 | G1946 | AC087771 | 4.10E−112 | [*Medicago truncatula*] | Genomic Sequence for *Medicago truncatula* clone 8D15, *** SEQUENCING IN PROGRESS 14 ordered pieces |
| 801 | G1946 | LEHSF8 (CAA47868) | 5.90E−103 | [*Lycopersicon esculentum*] | L.esculentum Le-hsf8 gene for heat stress transcription factor 8 |
| 801 | G1946 | AW569138 | 3.10E−75 | [*Glycine max*] | si63g09.y1 Gm-r1030 *Glycine max* cDNA clone GENOME SYSTEMS CLONE ID: Gm-r1030-3641 5 similar to- SW:HSF8 LYCPE P41153 HEAT SHOCK FACTOR PROTEIN HSF8:, mRNA sequence |
| 801 | G1946 | BG890899 | 1.30E−70 | [*Solanum tuberosum*] | EST516750 cSTD *Solanum tuberosum* cDNA clone cSTD20O23 5- sequence, mRNA sequence |
| 801 | G1946 | AC027658 | 4.60E−53 | [*Oryza sativa*] | *Oryza sativa* (*japonica cultivar*-group) japonica BAC nbxb0006I13, chromosome 10, complete sequence |
| 801 | G1946 | AV833112 | 4.90E−52 | [*Hordeum vulgare* subsp. *vulgare*] | AV833112 K. Sato unpublished cDNA library: *Hordeum vulgare* subsp. vulgare shoots germination *Hordeum vulgare* subsp. vulgare cDNA clone bags11o22, mRNA sequence |
| 801 | G1946 | gi19492 | 2.80E−121 | [*Lycopersicon peruvianum*] | heat shock transcription factor 8 [*Lycopersicon peruvianum*] |
| 801 | G1946 | gi19260 | 5.10E−106 | [*Lycopersicon esculentum*] | heat stress transcription factor 8 [*Lycopersicon esculentum*] |
| 801 | G1946 | gi662924 | 2.00E−47 | [*Glycine max*] | heat shock transcription factor 21 [*Glycine max*] |
| 801 | G1946 | gi5821138 | 9.70E−46 | [*Nicotiana tabacum*] | heat shock factor [*Nicotiana tabacum*] |
| 801 | G1946 | gi11761077 | 2.90E−40 | [*Oryza sativa*] | Putative heat shock factor protein 1 (HSF 1) [*Oryza sativa* (*japonica cultivar*-group)] |
| 801 | G1946 | gi886742 | 3.20E−40 | [*Zea mays*] | heat shock factor [*Zea mays*] |
| 801 | G1946 | gi7158882 | 2.70E−38 | [*Medicago sativa*] | heat shock transcription factor [*Medicago sativa*] |
| 801 | G1946 | gi3550588 | 1.90E−30 | [*Pisum sativum*] | heat shock transcription factor (HSFA) [*Pisum sativum*] |
| 801 | G1946 | gi100546 | 0.46 | [*Avena sativa*] | avenin precursor - oat. |
| 801 | G1946 | gi14190783 | 1 | [*Apium graveolens*] | putative phloem transcription factor M1 [*Apium graveolens*] |
| 239 | G375 | AW696439 | 3.40E−33 | [*Medicago truncatula*] | NF106B07ST1F1060 Developing stem *Medicago truncatula* cDNA clone NF106B07ST 5-, mRNA sequence |
| 239 | G375 | BG595870 | 1.90E−31 | [*Solanum tuberosum*] | EST494548 cSTS *Solanum tuberosum* cDNA clone cSTS12G9 5- sequence, mRNA sequence |
| 239 | G375 | AI899263 | 3.70E−31 | [*Lycopersicon esculentum*] | EST268706 tomato ovary, TAMU *Solanum lysmersicum* cDNA clone cLED38F7, mRNA sequence |
| 239 | G375 | NTBBF3 | 4.00E−31 | [*Nicotiana tabacum*] | N.tabacum mRNA for zinc finger protein, B, BBF3 |
| 239 | G375 | BG405482 | 2.70E−30 | [*Glycine max*] | sac44a11.y1 Gm-c1062 *Glycine max* cDNA clone GENOME SYSTEMS CLONE ID: Gm-c1062-2710 5- similar to TR:Q43575 Q43575 ZN FINGER PROTEIN;, mRNA sequence |
| 239 | G375 | AB028130 | 3.30E−30 | [*Oryza sativa*] | mRNA for Dof zinc finger protein, complete cds |
| 239 | G375 | AB026297 | 7.30E−28 | [*Pisum sativum*] | *Pisum sativum* mRNA for elicitor-responsive Dof protein ERDP, complete cds |
| 239 | G375 | HVBPBF (CAA04440) | 1.10E−27 | [*Hordeum vulgare*] | *Hordeum vulgare* mRNA for DNA binding protein BPBF. |
| 239 | G375 | BG263089 | 1.70E−27 | [*Triticum aestivum*] | WHE2337_A02_A03ZS Wheat pre-anthesis spike cDNA library *Triticum aestivum* cDNA clone WHE2337_A02_A03, mRNA sequence |

TABLE 4-continued

Orthologs of *Arabidopsis* sequences

| SEQ ID NO | GID | Test Sequence ID | Smallest Sum Probability | Test Sequence Species | Test Sequence GenBank Annotation |
|---|---|---|---|---|---|
| 239 | G375 | ZMU82230 | 4.20E−27 | [*Zea mays*] | *Zea mays* endosperm-specific prolamin box binding factor (PBF) mRNA, complete cds |
| 239 | G375 | gi4996640 | 1.90E−37 | [*Oryza sativa*] | Dof zinc finger protein [*Oryza sativa Japonica* Group] |
| 239 | G375 | gi3777436 | 8.10E−35 | [*Hordeum vulgare*] | DNA binding protein [*Hordeum vulgare* subsp. *vulgare*] |
| 239 | G375 | gi2393775 | 1.10E−33 | [*Zea mays*] | prolamin box binding factor [*Zea mays*] |
| 239 | G375 | gi1360088 | 2.00E−33 | [*Nicotiana tabacum*] | Zn finger protein [*Nicotiana tabacum*] |
| 239 | G375 | gi3790264 | 4.30E−32 | [*Triticum aestivum*] | PBF protein [*Triticum aestivum*] |
| 239 | G375 | gi6092016 | 1.30E−29 | [*Pisum sativum*] | elicitor responsive Dof protein ERDP [*Pisum sativum*] |
| 239 | G375 | gi7688355 | 5.60E−29 | [*Solanum tuberosum*] | Dof zinc finger protein [*Solanum tuberosum*] |
| 239 | G375 | gi1669341 | 4.60E−20 | [*Cucurbita maxima*] | AOBP (ascorbate oxidase promoter-binding protein) [*Cucurbita maxima*] |
| 239 | G375 | gi3929325 | 5.50E−18 | [*Dendrobium grex Madame Thong-In*] | putative DNA-binding protein [*Dendrobium grex Madame Thong-In*] |
| 239 | G375 | gi19547 | 5.50E−06 | [*Medicago sativa* subsp. *falcata*] | environmental stress and abscisic acid inducible protein [*Medicago falcata*] |
| 273 | G1255 | AC087181 | 1.60E−46 | [*Oryza sativa*] | *Oryza sativa Japonica* Group chromosome 3 clone OSJNBa0018H01 map R1538, complete sequence |
| 273 | G1255 | BG239774 | 4.50E−33 | [*Glycine max*] | sab74c03.y1 Gm-c1032 *Glycine max* cDNA clone GENOME SYSTEMS CLONE ID: Gm-c1032-2789 5- similar to TR:Q9SG21 Q9SG21 PUTATIVE B-BOX ZINC FINGER PROTEIN.:, mRNA sequence |
| 273 | G1255 | BG321336 | 1.70E−32 | [*Descurainia sophia*] | Ds01_06h10_A Ds01_AAFC_ECORC_cold_stressed_Flixweed_seedlings *Descurainia sophia* cDNA clone Ds01_06h10, mRNA sequence |
| 273 | G1255 | AI772841 | 2.90E−30 | [*Lycopersicon esculentum*] | EST253941 tomato resistant, Cornell Solanum *lycopersicum* cDNA clone cLER4C22, mRNA sequence |
| 273 | G1255 | BF480245 | 4.60E−29 | [*Mesembryanthemum crystallinum*] | L0-2152T3 Ice plant Lambda Uni-Zap XR expression library, 0 hours NaCl treatment *Mesembryanthemum crystallinum* cDNA clone L0-2152 5-, mRNA sequence |
| 273 | G1255 | AW688119 | 2.10E−28 | [*Medicago truncatula*] | NF002E07ST1F1000 Developing stem *Medicago truncatula* cDNA clone NF002E07ST 5-, mRNA sequence |
| 273 | G1255 | BF266327 | 1.80E−26 | [*Hordeum vulgare*] | HV_CEa0014N02f *Hordeum vulgare* seedling green leaf EST library HVcDNA0004 (Blumeria challenged) *Hordeum vulgare* subsp. *vulgare* cDNA clone HV_CEa0014N02f, mRNA sequence |
| 273 | G1255 | AW671538 | 5.80E−25 | [*Sorghum bicolor*] | LG1_348_B08.b1_A002 Light Grown 1 (LG1) *Sorghum bicolor* cDNA, mRNA sequence |
| 273 | G1255 | BI072021 | 5.30E−20 | [*Populus tremula x Populus tremuloides*] | C067P76U Populus strain T89 leaves *Populus tremula x Populus tremuloides* cDNA, mRNA sequence |
| 273 | G1255 | BG273908 | 4.90E−19 | [*Vitis vinifera*] | EST 110 Green Grape berries Lambda Zap II Library *Vitis vinifera* cDNA clone G82 3- similar to zinc finger protein, mRNA sequence |
| 273 | G1255 | gi13702811 | 3.70E−52 | [*Oryza sativa*] | putative zinc finger protein [*Oryza sativa*] |
| 273 | G1255 | gi11037311 | 4.00E−21 | [*Brassica nigra*] | constans-like protein [*Brassica nigra*] |
| 273 | G1255 | gi2303683 | 1.10E−19 | [*Brassica napus*] | unnamed protein product [*Brassica napus*] |
| 273 | G1255 | gi4091804 | 2.30E−18 | [*Malus x domestica*] | CONSTANS-like protein 1 [*Malus x domestica*] |
| 273 | G1255 | gi3341723 | 4.30E−18 | [*Raphanus sativus*] | CONSTANS-like 1 protein [*Raphanus sativus*] |
| 273 | G1255 | gi10946337 | 5.20E−17 | [*Ipomoea nil*] | CONSTANS-like protein [*Ipomoea nil*] |
| 273 | G1255 | gi4557093 | 3.30E−15 | [*Pinus radiata*] | zinc finger protein [*Pinus radiata*] |
| 273 | G1255 | gi8132543 | 0.97 | [*Chloroplast Zamia furfuracea*] | cytochrome b559 alpha subunit [*Zamia furfuracea*] |
| 273 | G1255 | gi11795 | 0.99 | [*Nicotiana tabacum*] | put. psbE protein (aa 1-83) |

TABLE 4-continued

Orthologs of *Arabidopsis* sequences

| SEQ ID NO | GID | Test Sequence ID | Smallest Sum Probability | Test Sequence Species | Test Sequence GenBank Annotation |
|---|---|---|---|---|---|
| 273 | G1255 | gi65646 | 0.99 | [*Chloroplast Nicotiana tabacum*] | RecName: Full= Cytochrome b559 component subunit alpha; AltName: Full=PSII reaction center subunit V |
| 557 | G865 | BE419451 | 3.70E−32 | [*Triticum aestivum*] | WWS012.C2R000101 ITEC WWS Wheat Scutellum Library *Triticum aestivum* cDNA clone WWS012.C2, mRNA sequence |
| 557 | G865 | AW560968 | 1.10E−28 | [*Medicago truncatula*] | EST316016 DSIR *Medicago truncatula* cDNA clone pDSIR-30N21, mRNA sequence |
| 557 | G865 | AW782252 | 1.20E−26 | [*Glycine max*] | sm03d11.y1 Gm-c1027 *Glycine max* cDNA clone GENOME SYSTEMS CLONE ID: Gm-c1027-7822 5- similar to TR:P93007 P93007 CADMIUM-INDUCED PROTEIN ISOLOG.;, mRNA sequence |
| 557 | G865 | BI421895 | 3.60E−25 | [*Lycopersicon esculentum*] | EST532561 tomato callus, TAMU *Lycopersicon esculentum* cDNA clone cLEC68E16 5' end, mRNA sequence |
| 557 | G865 | BE642320 | 1.60E−24 | [*Ceratopteris richardii*] | Cri2_5_L17_SP6 *Ceratopteris* Spore Library *Ceratopteris richardii* cDNA clone Cri2_5_L17 5-, mRNA sequence |
| 557 | G865 | BE494041 | 1.60E−24 | [*Secale cereale*] | WHE1277_B09_D17ZS *Secale cereale* anther cDNA library *Secale cereale* cDNA clone WHE1277_B09_D17, mRNA sequence |
| 557 | G865 | D39914 | 2.60E−24 | [*Oryza sativa*] | RICS1576A Rice shoot *Oryza sativa* Japonica Group cDNA, mRNA sequence |
| 557 | G865 | AV428124 | 9.00E−23 | [*Lotus japonicus*] | AV428124 *Lotus japonicus* young plants (two-week old) *Lotus japonicus* cDNA clone MWM092d01_r5-, mRNA sequence |
| 557 | G865 | TOBBY4D | 1.80E−21 | [*Nicotiana tabacum*] | Tobacco mRNA for EREBP-2, mRNA for ethylene-responsive element binding protein, complete cds. |
| 557 | G865 | gi1208495 | 2.40E−23 | [*Nicotiana tabacum*] | ERF1 [*Nicotiana tabacum*] |
| 557 | G865 | gi8809571 | 5.10E−23 | [*Nicotiana sylvestris*] | ethylene-responsive element binding factor [*Nicotiana sylvestris*] |
| 557 | G865 | gi3342211 | 1.40E−22 | [*Lycopersicon esculentum*] | Pti4 [*Lycopersicon esculentum*] |
| 557 | G865 | gi7528276 | 1.70E−22 | [*Mesembryanthemum crystallinum*] | AP2-related transcription factor [*Mesembryanthemum crystallinum*] |
| 557 | G865 | gi15217291 | 7.80E−22 | [*Oryza sativa*] | Putative AP2 domain containing protein [*Oryza sativa* Japonica Group] |
| 557 | G865 | gi3264767 | 2.70E−21 | [*Prunus armeniaca*] | AP2 domain containing protein [*Prunus armeniaca*] |
| 557 | G865 | gi8980313 | 2.10E−20 | [*Catharanthus roseus*] | AP2-domain DNA-binding protein [*Catharanthus roseus*] |
| 557 | G865 | gi8571476 | 9.30E−20 | [*Atriplex hortensis*] | apetala2 domain-containing protein [*Atriplex hortensis*] |
| 557 | G865 | gi1688233 | 1.40E−19 | [*Solanum tuberosum*] | DNA binding protein homolog [*Solanum tuberosum*] |
| 557 | G865 | gi6478845 | 1.80E−19 | [*Matricaria chamomilla*] | ethylene-responsive element binding protein 1 homolog, partial [*Matricaria chamomilla*] |
| 23 | G2509 | BH577856 | 2.50E−29 | [*Brassica oleracea*] | BOHOJ67TR BOHO *Brassica oleracea* genomic clone BOHOJ67, genomic survey sequence |
| 23 | G2509 | BM269574 | 5.90E−28 | [*Glycine max*] | sak01e08.y1 Gm-c1074 *Glycine max* cDNA clone SOYBEAN CLONE ID: Gm-c1074-4839 5- similar to TR:P93007 P93007 CADMIUM-INDUCED PROTEIN ISOLOG.;, mRNA sequence |
| 23 | G2509 | BE419451 | 2.20E−27 | [*Triticum aestivum*] | WWS012.C2R000101 ITEC WWS Wheat Scutellum Library *Triticum aestivum* cDNA clone WWS012.C2 mRNA sequence |
| 23 | G2509 | AI483636 | 7.80E−27 | [*Lycopersicon esculentum*] | EST249507 tomato ovary, TAMU *Lycopersicon esculentum* cDNA clone cLED25J16, mRNA sequence |
| 23 | G2509 | AW560968 | 8.90E−27 | [*Medicago truncatula*] | EST316016 DSIR *Medicago truncatula* cDNA clone pDSIR-30N21, mRNA sequence |
| 23 | G2509 | BE642320 | 4.30E−26 | [*Ceratopteris richardii*] | Cri2_5_L17_SP6 *Ceratopteris* Spore Library *Ceratopteris richardii* cDNA clone Cri2_5_L17_5-, mRNA sequence |
| 23 | G2509 | AP003286 | 1.00E−25 | [*Oryza sativa*] | chromosome 1 clone P0677H08, * ** SEQUENCING IN PROGRESS *** |

TABLE 4-continued

Orthologs of *Arabidopsis* sequences

| SEQ ID NO | GID | Test Sequence ID | Smallest Sum Probability | Test Sequence Species | Test Sequence GenBank Annotation |
|---|---|---|---|---|---|
| 23 | G2509 | BE494041 | 3.20E−25 | [*Secale cereale*] | WHE1277_B09_D17ZS *Secale cereale* anther cDNA library Secale cereale cDNA clone WHE1277_B09_D17. mRNA sequence |
| 23 | G2509 | BE602106 | 1.10E−24 | [*Hordeum vulgare*] | HVSMEh0102I06f *Hordeum vulgare* 5-45 DAP spike EST library HVcDNA0009 (5 to 45 DAP) *Hordeum vulgare* subsp. *vulgare* cDNA clone HVSMEh0102I06f, mRNA sequence |
| 23 | G2509 | AV428124 | 1.00E−23 | [*Lotus japonicus*] | AV428124 *Lotus japonicus* young plants (two-week old) *Lotus japonicus* cDNA clone MWM092d01_r 5-, mRNA sequence |
| 23 | G2509 | gi3264767 | 4.00E−27 | [*Prunus armeniaca*] | AP2 domain containing protein [*Prunus armeniaca*] |
| 23 | G2509 | gi12003376 | 1.40E−23 | [*Nicotiana tabacum*] | Avr9/Cf-9 rapidly elicited protein 1 [*Nicotiana tabacum*] |
| 23 | G2509 | gi14140141 | 2.30E−23 | [*Oryza sativa*] | putative AP2-related transcription factor [*Oryza sativa*] |
| 23 | G2509 | gi1688233 | 5.40E−23 | [*Solanum tuberosum*] | DNA binding protein homolog [*Solanum tuberosum*] |
| 23 | G2509 | gi4099921 | 2.60E−22 | [*Stylosanthes hamata*] | EREBP-3 homolog [*Stylosanthes hamata*] |
| 23 | G2509 | gi8809571 | 7.80E−22 | [*Nicotiana sylvestris*] | ethylene-responsive element binding factor [*Nicotiana sylvestris*] |
| 23 | G2509 | gi3342211 | 1.00E−21 | [*Lycopersicon esculentum*] | Pti4 [*Lycopersicon esculentum*] |
| 23 | G2509 | gi7528276 | 2.70E−21 | [*Mesembryanthemum crystallinum*] | AP2-related transcription factor [*Mesembryanthemum crystallinum*] |
| 23 | G2509 | gi17385636 | 1.90E−20 | [*Matricaria chamomilla*] | ethylene-responsive element binding protein 1 homolog [*Matricaria chamomilla*] |
| 23 | G2509 | gi18496063 | 3.30E−20 | [*Fagus sylvatica*] | ethylene responsive element binding protein [*Fagus sylvatica*] |
| 1119 | G2347 | BI931517 | 5.30E−31 | [*Lycopersicon esculentum*] | EST551406 tomato flower, 8 mm to preanthesis buds *Lycopersicon esculentum* cDNA clone cTOC20E12 5- end, mRNA sequence |
| 1119 | G2347 | BE058432 | 4.20E−29 | [*Glycine max*] | sn16a06.y1 Gm-c1016 *Glycine max* cDNA clone GENOME SYSTEMS CLONE ID: Gm-c1016-11627 5 similar to SW:SBP1_ANTMA Q38741 SQUAMOSA-PROMOTER BINDING PROTEIN 1. [1];, mRNA sequence |
| 1119 | G2347 | AMSPBI (CAA63113) | 1.80E−28 | [*Antirrhinum majus*] | *A.majus* mRNA for squamosa-promoter binding protein 1 |
| 1119 | G2347 | BG525285 | 5.70E−28 | [*Stevia rebaudiana*] | 48-3 *Stevia* field grown leaf cDNA *Stevia rebaudiana* cDNA 5-, mRNA sequence |
| 1119 | G2347 | L38193 | 4.60E−27 | [*Brassica rapa*] | BNAF1025E Mustard flower buds *Brassica rapa* cDNA clone F1025, mRNA sequence |
| 1119 | G2347 | BG455868 | 6.40E−27 | [*Medicago truncatula*] | NF068F05PLIF1045 Phosphate starved leaf *Medicago truncatula* cDNA clone NF068F05PL 5-, mRNA sequence |
| 1119 | G2347 | BG097153 | 1.70E−24 | [*Solanum tuberosum*] | EST461672 potato leaves and petioles *Solanum tuberosum* cDNA clone cSTB46A21 5- sequence, mRNA sequence |
| 1119 | G2347 | BF482644 | 1.60E−23 | [*Triticum aestivum*] | WHE2301-2304_A21_A21ZS Wheat pre-anthesis spike cDNA library *Triticum aestivum* cDNA clone WHE2301-2304_A21_A21, mRNA sequence |
| 1119 | G2347 | AW747167 | 2.30E−23 | [*Sorghum bicolor*] | WS1_66_F11.b1_A002 Water-stressed 1 (WSI) *Sorghum bicolor* cDNA, mRNA sequence |
| 1119 | G2347 | BG442540 | 2.50E−23 | [*Gossypium arboreum*] | GA_Ea0017G06f *Gossypium arboreum* 7-10 dpa fiber library Gossypium arboreum cDNA clone GA_Ea0017G06f, mRNA sequence |
| 1119 | G2347 | gi1183864 | 1.50E−31 | [*Antirrhinum majus*] | squamosa-promoter binding protein 2 [*Antirrhinum majus*] |
| 1119 | G2347 | gi5931786 | 3.40E−25 | [*Zea mays*] | SBP-domain protein 5 [*Zea mays*] |
| 1119 | G2347 | gi8468036 | 1.40E−21 | [*Oryza sativa*] | Similar to Arabidopsis thaliana chromosome 2 BAC F14M4: unknown protein (AC004411) [*Oryza sativa*] |

TABLE 4-continued

Orthologs of Arabidopsis sequences

| SEQ ID NO | GID | Test Sequence ID | Smallest Sum Probability | Test Sequence Species | Test Sequence GenBank Annotation |
|---|---|---|---|---|---|
| 1119 | G2347 | gi9087308 | 6.60E−09 | [Mitochondrion Beta vulgaris var. altissima] | orf102a [Beta vulgaris subsp. vulgaris] |
| 1119 | G2347 | gi7209500 | 0.83 | [Brassica rapa] | S-locus pollen protein [Brassica rapa] |
| 43 | G988 | CRU303349 (CAC36387) | 3.10E−208 | [Capsella rubella] | CRU303349 Capsella rubella ORF1, ORF2, ORF3, ORF4, ORES and ORF6 (partial) |
| 43 | G988 | A84072 | 4.50E−86 | [Lycopersicon esculentum] | Sequence 1 from Patent WO9846759 |
| 43 | G988 | A84080 | 3.30E−85 | [Solanum tuberosum] | Sequence 9 from Patent WO9846759 |
| 43 | G988 | AP003944 | 1.30E−57 | [Oryza sativa] | chromosome 6 clone OJ1126_F05, *** SEQUENCING IN PROGRESS *** |
| 43 | G988 | AX081276 | 2.80E−43 | [Brassica napus] | Sequence 1 from Patent WO0109356 |
| 43 | G988 | ZMA242530 (CAB51557) | 1.50E−40 | [Zea mays] | partial d8 gene for gibberellin response modulator |
| 43 | G988 | AX005804 | 2.50E−37 | [Triticum aestivum] | Sequence13 from Patent WO9909174 |
| 43 | G988 | AB048713 | 9.10E−33 | [Pisum sativum] | PsSCR mRNA for SCARECROW, complete cds |
| 43 | G988 | AW774515 | 2.00E−29 | [Medicago truncatula] | EST333666 KV3 Medicago truncatula cDNA clone pKV3-22F24, mRNA sequence |
| 43 | G988 | BE822458 | 1.20E−27 | [Glycine max] | GM700017A20H12 Gm-r1070 Glycine max cDNA clone Gm-r1070-6888 3-, mRNA sequence |
| 43 | G988 | gi13620166 | 8.00E−211 | [Capsella rubella] | hypothetical protein [Capsella rubella] |
| 43 | G988 | gi4160441 | 1.40E−87 | [Lycopersicon esculentum] | lateral suppressor protein [Lycopersicon esculentum] |
| 43 | G988 | gi10178637 | 2.20E−48 | [Zea mays] | SCARECROW [Zea mays] |
| 43 | G988 | gi6970472 | 1.20E−47 | [Oryza sativa] | OsGAI [Oryza sativa Japonica Group] |
| 43 | G988 | gi5640157 | 2.80E−45 | [Triticum aestivum] | gibberellin response modulator [Triticum aestivum] |
| 43 | G988 | gi13170126 | 7.10E−45 | [Brassica napus] | unnamed protein product [Brassica napus] |
| 43 | G988 | gi13365610 | 1.10E−40 | [Pisum sativum] | SCARECROW [Pisum sativum] |
| 43 | G988 | gi14318115 | 1.10E−14 | [Zea mays subsp. mays] | gibberellin response modulator, partial [Zea mays subsp. mays] |
| 43 | G988 | gi14318165 | 7.30E−14 | [Tripsacum dactyloides] | gibberellin response modulator, partial [Tripsacum dactyloides] |
| 43 | G988 | gi347457 | 2.40E−05 | [Glycine max] | hydroxyproline-rich glycoprotein. partial [Glycine max] |
| 459 | G2346 | AMA011622 (CAB56569) | 3.10E−35 | [Antirrhinum majus] | Antirrhinum majus mRNA for squamosa promoter binding protein-homologue 4, partial |
| 459 | G2346 | AW691786 | 1.80E−26 | [Medicago truncatula] | NF044B06ST1F1000 Developing stem Medicago truncatula cDNA clone NF044B06ST 5-, mRNA sequence |
| 459 | G2346 | AQ273505 | 7.00E−25 | [Oryza sativa] | nbxb0030O03f CUGI Rice BAC Library Oryza Japonica Group genomic clone nbxb0030O03f, genomic survey sequence |
| 459 | G2346 | AW932595 | 7.90E−24 | [Lycopersicon esculentum] | EST358438 tomato fruit mature green, TAMU Lycopersicon esculentum cDNA clone cLEF49E12 5-, mRNA sequence |
| 459 | G2346 | BG593787 | 9.50E−24 | [Solanum tuberosum] | EST492465 cSTS Solanum tuberosum cDNA clone cSTS5M24 5- sequence, mRNA sequence |
| 459 | G2346 | BG442540 | 1.00E−23 | [Gossypium arboreum] | GA_Ea0017G06f Gossypium arboreum 7-10 dpa fiber library Gossypium arboreum cDNA clone GA_Ea0017G06f, mRNA sequence |
| 459 | G2346 | AZ919034 | 1.90E−23 | [Zea mays] | 1006013G02.x3 1006 - RescueMu Grid G Zea mays genomic, genomic survey sequence |
| 459 | G2346 | BE596165 | 2.70E−23 | [Sorghum bicolor] | PI1_50_D04.b1_A002 Pathogen induced 1 (PI1) Sorghum bicolor cDNA, mRNA sequence |
| 459 | G2346 | AI443033 | 2.30E−22 | [Glycine max] | sa31a08.y1 Gm-c1004 Glycine max cDNA clone GENOME SYSTEMS CLONE ID: Gm-c1004-879 5- similar to TR:O04003 O04003 LIGULELESS1 PROTEIN.;, mRNA sequence |

TABLE 4-continued

Orthologs of *Arabidopsis* sequences

| SEQ ID NO | GID | Test Sequence ID | Smallest Sum Probability | Test Sequence Species | Test Sequence GenBank Annotation |
|---|---|---|---|---|---|
| 459 | G2346 | BF482644 | 4.30E−22 | [*Triticum aestivum*] | WHE2301-2304_A21_A21ZS Wheat pre-anthesis spike cDNA library *Triticum aestivum* cDNA clone WHE2301-2304_A21_A21, mRNA sequence |
| 459 | G2346 | gi5931643 | 6.20E−45 | [*Antirrhinum majus*] | squamosa promoter binding protein-homologue 5 [*Antirrhinum majus*] |
| 459 | G2346 | gi5931786 | 4.20E−26 | [*Zea mays*] | SBP-domain protein 5 [*Zea mays*] |
| 459 | G2346 | gi8468036 | 3.30E−14 | [*Oryza sativa*] | Similar to *Arabidopsis thaliana* chromosome 2 BAC F14M4: unknown protein (AC004411) [*Oryza saliva*] |
| 459 | G2346 | gi9087308 | 8.30E−08 | [*Mitochondrion Beta vulgaris* var. *altissima*] | orf102a [*Beta vulgaris* subsp. *vulgaris*] |
| 285 | G1354 | BG128374 | 2.90E−58 | [*Lycopersicon esculentum*] | EST474020 tomato shoot/meristem *Lycopersicon esculentum* cDNA clone cTOF20M10 5- sequence, mRNA sequence |
| 285 | G1354 | BE202831 | 1.90E−56 | [*Medicago truncatula*] | EST402853 KV1 *Medicago truncatula* cDNA clone pKV1-3M14, mRNA sequence |
| 285 | G1354 | AI161918 | 6.60E−55 | [*Populus tremula x Populus tremuloides*] | A009P50U Hybrid aspen plasmid library *Populus tremula x Populus tremuloides* cDNA 5-, mRNA sequence |
| 285 | G1354 | AB028186 | 1.20E−53 | [*Oryza sativa*] | mRNA for OsNAC7 protein, complete cds |
| 285 | G1354 | BE060921 | 8.00E−50 | [*Hordeum vulgare*] | HVSMEg0013N15f *Hordeum vulgare* pre-anthesis spike EST library HVcDNA0008 (white to yellow anther) *Hordeum vulgare* subsp. *vulgare* cDNA clone HVSMEg0013N15f, mRNA sequence |
| 285 | G1354 | AF402603 | 1.50E−42 | [*Phaseolus vulgaris*] | NAC domain protein NAC2 mRNA, complete cds |
| 285 | G1354 | BE357920 | 1.60E−42 | [*Sorghum bicolor*] | DG1_23_F03.b1_A002 Dark Grown 1 (DG1) *Sorghum bicolor* cDNA, mRNA sequence |
| 285 | G1354 | PHRNANAM (CAA63102) | 3.60E−42 | [*Petunia x hybrida*] | *P.hybrida* mRNA encoding NAM protein |
| 285 | G1354 | AW185617 | 5.30E−40 | [*Glycine max*] | se80b05.y1 Gm-c1023 *Glycine max* cDNA clone GENOME SYSTEMS CLONE ID: Gm-c1023-970 5- similar to TR:Q40880 Q40880 NAM GENE. [1];, mRNA sequence |
| 285 | G1354 | gi6006373 | 4.50E−63 | [*Oryza sativa*] | Similar to NAM like protein (AC005310) [*Oryza sativa*] |
| 285 | G1354 | gi15148914 | 2.30E−44 | [*Phaseolus vulgaris*] | NAC domain protein NAC2 [*Phaseolus vulgaris*] |
| 285 | G1354 | gi14485513 | 3.50E−44 | [*Solanum tuberosum*] | putative NAC domain protein [*Solanum tuberosum*] |
| 285 | G1354 | gi1279640 | 5.90E−44 | [*Petunia x hybrida*] | NAM [*Petunia x hybrida*] |
| 285 | G1354 | gi6175246 | 5.20E−41 | [*Lycopersicon esculentum*] | jasmonic acid 2 [*Solanum lycopersicum*] |
| 285 | G1354 | gi4218535 | 5.10E−39 | [*Triticum sp.*] | GRAB1 protein [*Triticum sp.*] |
| 285 | G1354 | gi6732158 | 5.10E−39 | [*Triticum monococcum*] | unnamed protein product [*Triticum monococcum*] |
| 285 | G1354 | gi7716952 | 3.30E−35 | [*Medicago truncatula*] | NAC1 [*Medicago truncatula*] |
| 285 | G1354 | gi4996349 | 2.50E−26 | [*Nicotiana tabacum*] | NAC-domain protein [*Nicotiana tabacum*] |
| 285 | G1354 | gi2982275 | 3.10E−14 | [*Picea mariana*] | ATAF1-like protein [*Picea mariana*] |
| 119 | G1063 | BH700922 | 4.50E−90 | [*Brassica oleracea*] | BOMMZO7TR BO_2_3_KB *Brassica oleracea* genomic clone BOMMZ07, genomic survey sequence |
| 119 | G1063 | BE451174 | 2.40E−41 | [*Lycopersicon esculentum*] | EST402062 tomato root, plants pre-anthesis, Cornell University *Lycopersicon esculentum* cDNA clone cLEY16H6, mRNA sequence |
| 119 | G1063 | AW832545 | 2.00E−40 | [*Glycine max*] | sm12e10.y1 Gm-c1027 *Glycine max* cDNA clone GENOME SYSTEMS CLONE ID: Gm-c1027-8707 5- similar to TR:O81313 O81313 F6N15.18 PROTEIN.:, mRNA sequence |
| 119 | G1063 | AP004693 | 5.90E−37 | [*Oryza sativa*] | chromosome 8 clone P0461F06, *** SEQUENCING IN PROGRESS *** |

TABLE 4-continued

Orthologs of *Arabidopsis* sequences

| SEQ ID NO | GID | Test Sequence ID | Smallest Sum Probability | Test Sequence Species | Test Sequence GenBank Annotation |
|---|---|---|---|---|---|
| 119 | G1063 | AP004462 | 4.40E−32 | [*Oryza sativa* (*japonica* cultivar-group)] | *Oryza sativa* chromosome 8 clone P0450B04, *** SEQUENCING IN PROGRESS *** |
| 119 | G1063 | AT002234 | 8.90E−32 | [*Brassica rapa* subsp. *pekinensis*] | AT002234 Flower bud cDNA *Brassica rapa* subsp. *pekinensis* cDNA clone RF1050,. mRNA sequence |
| 119 | G1063 | BF263465 | 5.40E−25 | [*Hordeum vulgare*] | HV_CEa0006N02f *Hordeum vulgare* seedling green leaf EST library HVcDNA0004 (Blumeria challenged) *Hordeum vulgare* subsp. *vulgare* cDNA clone HV_CEa0006N02f, mRNA sequence |
| 119 | G1063 | BG557011 | 4.20E−22 | [*Sorghum bicolor*] | EM1_41_E02.g1_A002 Embryo 1 (EM1) *Sorghum bicolor* cDNA, mRNA sequence |
| 119 | G1063 | BG842856 | 3.10E−21 | [*Zea mays*] | MEST40-H05.T3 ISUM4-TN *Zea mays* cDNA clone MEST40-H05 3-, mRNA sequence |
| 119 | G1063 | BG559930 | 1.40E−18 | [*Sorghum propinquum*] | RHIZ2_75_D09.g1_A003 Rhizome2 (RHIZ2) *Sorghum propinquum* cDNA, mRNA |
| 119 | G1063 | gi15528743 | 4.20E−26 | [*Oryza sativa*] | contains EST C74560(E31855)-unknown protein [*Oryza sativa*] |
| 119 | G1063 | gi6166283 | 8.10E−10 | [*Pinus taeda*] | helix-loop-helix protein 1A [*Pinus taeda*] |
| 119 | G1063 | gi11045087 | 8.80E−09 | [*Brassica napus*] | putative protein [*Brassica napus*] |
| 119 | G1063 | gi10998404 | 7.10E−08 | [*Petunia x hybrida*] | anthocyanin 1 [*Petunia x hybrida*] |
| 119 | G1063 | gi99441 | 2.60E−07 | [*Volvox carteri*] | sulfated surface glycoprotein 185 - *Volvox carteri* |
| 119 | G1063 | gi1142621 | 5.00E−07 | [*Phaseolus vulgaris*] | phaseolin G-box binding protein PG2, partial [*Phaseolus vulgaris*] |
| 119 | G1063 | gi166428 | 8.10E−07 | [*Antirrhinum majus*] | DEL [*Antirrhinum majus*] |
| 119 | G1063 | gi1247386 | 9.50E−07 | [*Nicotiana alata*] | PRP2 [*Nicotiana alata*] |
| 119 | G1063 | gi82091 | 1.00E−06 | [*Lycopersicon esculentum*] | hydroxyproline-rich glycoprotein - tomato (fragment) |
| 119 | G1063 | gi1486263 | 1.40E−06 | [*Catharanthus roseus*] | extension [*Catharanthus roseus*] |
| 129 | G2143 | BH650724 | 3.00E−88 | [*Brassica oleracea*] | BOMIW43TR BO_2_3_KB *Brassica oleracea* genomic clone BOMIW43, genomic survey sequence |
| 129 | G2143 | AW832545 | 1.50E−40 | [*Glycine max*] | sm12e10.y1 Gm-c1027 *Glycine max* cDNA clone GENOME SYSTEMS CLONE ID: Gm-c1027-8707 5- similar to TR:O81313 O81313 F6N15.18 PROTEIN.;, mRNA sequence |
| 129 | G2143 | BE451174 | 3.50E−40 | [*Lycopersicon esculentum*] | EST402062 tomato root, plants pre-anthesis, Cornell University *Solanum lycopersicum* cDNA clone cLEY16H6, mRNA sequence |
| 129 | G2143 | AP004693 | 4.00E−38 | [*Oryza sativa*] | chromosome 8 clone P0461F06, *** SEQUENCING IN PROGRESS *** |
| 129 | G2143 | AP004584 | 6.30E−33 | [*Oryza sativa* (*japonica* cultivar-group)] | *Oryza sativa* chromosome 8 clone P0007D08, *** SEQUENCING IN PROGRESS *** |
| 129 | G2I43 | AT002234 | 3.00E−31 | [*Brassica rapa* subsp. *pekinensis*] | AT002234 Flower bud cDNA *Brassica rapa* subsp. *pekinensis* cDNA clone RF1050, mRNA sequence |
| 129 | G2143 | BF263465 | 2.90E−26 | [*Hordeum vulgare*] | HV_CEa0006N02f *Hordeum vulgare* seedling green leaf EST library HVcDNA0004 (Blumeria challenged) *Hordeum vulgare* subsp. *vulgare* cDNA clone HV_CEa0006N02f, mRNA sequence |
| 129 | G2143 | BG557011 | 2.60E−22 | [*Sorghum bicolor*] | EM1_41_E02.g1_A002 Embryo 1 (EM1) *Sorghum bicolor* cDNA, mRNA sequence |
| 129 | G2143 | BG842856 | 3.50E−20 | [*Zea mays*] | MEST40-H05.T3 ISUM4-TN *Zea mays* cDNA clone MEST40-1105 3-, mRNA sequence |
| 129 | G2143 | BG559930 | 6.10E−18 | [*Sorghum propinquum*] | RHIZ2_75_D09.g1_A003 Rhizome2 (RHIZ2) *Sorghum propinquum* cDNA, mRNA |
| 129 | G2143 | gi15528743 | 5.50E−26 | [*Oryza sativa*] | contains EST C74560(E31855)-unknown protein [*Oryza sativa*] |
| 129 | G2143 | gi1086538 | 7.60E−09 | [*Oryza rufipogon*] | transcriptional activator Rb homolog, partial [*Oryza rufipogon*] |

TABLE 4-continued

Orthologs of Arabidopsis sequences

| SEQ ID NO | GID | Test Sequence ID | Smallest Sum Probability | Test Sequence Species | Test Sequence GenBank Annotation |
|---|---|---|---|---|---|
| 129 | G2143 | gi6166283 | 1.10E−08 | [Pinus taeda] | helix-loop-helix protein 1A [Pinus taeda] |
| 129 | G2143 | gi1142621 | 4.60E−07 | [Phaseolus vulgaris] | phaseolin G-box binding protein PG2, partial [Phaseolus vulgaris] |
| 129 | G2143 | gi3399777 | 5.20E−07 | [Glycine max] | symbiotic ammonium transporter; nodulin; [Glycine max] |
| 129 | G2143 | gi5923912 | 6.10E−07 | [Tulipa gesneriana] | bHLH transcription factor GBOF-1 [Tulipa gesneriana] |
| 129 | G2143 | gi10998404 | 9.20E−07 | [Petunia x hybrida] | anthocyanin 1 [Petunia x hybrida] |
| 129 | G2143 | gi4321762 | 5.20E−06 | [Zea mays] | transcription factor MYC7E [Zea mays] |
| 129 | G2143 | gi166428 | 6.00E−06 | [Antirrhinum majus] | DEL [Antirrhinum majus] |
| 129 | G2143 | gi527665 | 7.40E−06 | [Sorghum bicolor] | myc-like regulatory R gene product, partial [Sorghum bicolor] |
| 133 | G2557 | BH511840 | 6.70E−62 | [Brassica oleracea] | BOGRJ19TR BOGR Brassica oleracea genomic clone BOGRJ19, genomic survey |
| 133 | G2557 | BE347811 | 3.70E−46 | [Glycine max] | sp05h10.y1 Gm-c1041 Glycine max cDNA clone GENOME SYSTEMS CLONE ID: Gm-c1041-2012 5- similar to TR:O81313 O81313 F6N15.18 PROTEIN.;, mRNA sequence |
| 133 | G2557 | AP003141 | 2.40E−33 | [Oryza sativa] | Oryza sativa Japonica Group genomic DNA, chromosome 1, PAC clone:P0002B05, |
| 133 | G2557 | BF263465 | 3.00E−31 | [Hordeum vulgare] | HV_CEa0006N02f Hordeum vulgare seedling green leaf EST library HVcDNA0004 (Blumeria challenged) Hordeum vulgare subsp. vulgare cDNA clone HV_CEa0006N02f, mRNA sequence |
| 133 | G2557 | AT002234 | 6.60E−27 | [Brassica rapa subsp. pekinensis] | AT002234 Flower bud cDNA Brassica rapa subsp. pekinensis cDNA clone RF1050, mRNA seuence |
| 133 | G2557 | BG557011 | 6.40E−26 | [Sorghum bicolor] | EM1_41_E02.g1_A002 Embryo 1 (EM1) Sorghum bicolor cDNA, mRNA sequence |
| 133 | G2557 | AP004462 | 7.90E−26 | [Oryza sativa (japonica cultivar-group)] | Oryza sativa chromosome 8 clone P0450B04, *** SEQUENCING IN PROGRESS *** |
| 133 | G2557 | BE451174 | 3.90E−25 | [Lycopersicon esculentum] | EST402062 tomato root, plants pre-anthesis, Cornell University Solanum lycopersicum cDNA clone cLEY16H6, mRNA sequence |
| 133 | G2557 | BG842856 | 5.60E−22 | [Zea mays] | MEST40-H05.T3 ISUM4-TN Zea mays cDNA clone MEST40-H05 3-, mRNA sequence |
| 133 | G2557 | BG559930 | 7.00E−14 | [Sorghum propinquum] | RHIZ2_75_D09.g1_A003 Rhizome2 (RHIZ2) Sorghum propinquum cDNA, mRNA |
| 133 | G2557 | gi15289790 | 2.40E−36 | [Oryza sativa] | contains EST C74560(E31855)~unknown protein. |
| 133 | G2557 | gi3399777 | 2.60E−06 | [Glycine max] | symbiotic ammonium transporter; nodulin; [Glycine max] |
| 133 | G2557 | gi4206118 | 1.10E−05 | [Mesembryanthemum crystallinum] | transporter homolog [Mesembryanthemum crystallinum] |
| 133 | G2557 | gi6166283 | 1.30E−05 | [Pinus taeda] | helix-loop-helix protein 1A [Pinus taeda] |
| 133 | G2557 | gi527655 | 3.70E−05 | [Pennisetum glaucum] | myc-like regulatory R gene product, partial [Cenchrus americanus] |
| 133 | G2557 | gi5923912 | 3.70E−05 | [Tulipa gesneriana] | bHLH transcription factor GBOF-1 [Tulipa gesneriana] |
| 133 | G2557 | gi527661 | 7.80E−05 | [Phyllostachys acuta] | myc-like regulatory R gene product, partial [Phyllostachys acuta] |
| 133 | G2557 | gi527665 | 9.50E−05 | [Sorghum bicolor] | myc-like regulatory R gene product, partial [Sorghum bicolor] |
| 133 | G2557 | gi1086538 | 0.0001 | [Oryza rufipogon] | transcriptional activator Rb homolog, partial [Oryza rufipogon] |
| 133 | G2557 | gi5669656 | 0.00013 | [Lycopersicon esculentum] | ER33 protein [Solanum lycopersicum] |
| 697 | G2430 | BF632520 | 1.90E−14 | [Medicago truncatula] | NF039A08DT1F1054 Drought Medicago truncatula cDNA clone NF039A08DT 5-, mRNA sequence |
| 697 | G2430 | AW396912 | 1.20E−13 | [Glycine max] | sg64g09.y1 Gm-c1007 Glycine max cDNA clone GENOME SYSTEMS CLONE ID: Gm-c1007-1241 5- similar to TR:Q9ZWK0 Q9ZWK0 ARR1 PROTEIN.;, mRNA sequence |

TABLE 4-continued

Orthologs of *Arabidopsis* sequences

| SEQ ID NO | GID | Test Sequence ID | Smallest Sum Probability | Test Sequence Species | Test Sequence GenBank Annotation |
|---|---|---|---|---|---|
| 697 | G2430 | D41804 | 4.50E−13 | [*Oryza sativa*] | RICS4626A Rice shoot *Oryza sativa* cDNA, mRNA sequence |
| 697 | G2430 | BE214029 | 2.60E−10 | [*Hordeum vulgare*] | HV_CEb0001P06f *Hordeum vulgare* seedling green leaf EST library HVcDNA0005 (Blumeria challenged) *Hordeum vulgare* subsp. *vulgare* cDNA clone HV_CEb0001P06f, mRNA sequence |
| 697 | G2430 | AW564570 | 2.70E−10 | [*Sorghum bicolor*] | LG1_296_E01.b1_A002 Light Grown 1 (LG1) *Sorghum bicolor* cDNA, mRNA sequence |
| 697 | G2430 | BG129795 | 5.40E−10 | [*Lycopersicon esculentum*] | EST475441 tomato shoot/meristem *Lycopersicon esculentum* cDNA clone cTOF28C12 5- sequence, mRNA sequence |
| 697 | G2430 | AB060130 | 5.40E−09 | [*Zea mays*] | ZmRR8 mRNA for response regulator 8, complete cds. |
| 697 | G2430 | BF587105 | 2.50E−05 | [*Sorghum propinquum*] | FM1_32_C05.b1_A003 Floral-Induced Meristem 1 (FM1) *Sorghum propinquum* cDNA, mRNA sequence |
| 697 | G2430 | AI163121 | 0.3 | [*Populus tremula x Populus tremuloides*] | A033P70U Hybrid aspen plasmid library *Populus tremula x Populus tremuloides* cDNA 5-, mRNA sequence |
| 697 | G2430 | BG595628 | 0.46 | [*Solanum tuberosum*] | EST494306 cSTS *Solanum tuberosum* cDNA clone cSTS11C11 5- sequence, mRNA sequence |
| 697 | G2430 | gi13661174 | 5.40E−18 | [*Zea mays*] | response regulator 8 [*Zea mays*] |
| 697 | G2430 | gi15289981 | 0.028 | [*Oryza sativa*] | hypothetical protein [*Oryza sativa*] |
| 697 | G2430 | gi6942190 | 0.12 | [*Mesembryanthemum crystallinum*] | CDPK substrate protein 1; CSP1 [*Mesembryanthemum crystallinum*] |
| 697 | G2430 | gi4519671 | 0.2 | [*Nicotiana tabacum*] | transfactor [*Nicotiana tabacum*] |
| 831 | G1478 | BF275913 | 1.50E−20 | [*Gossypium arboreum*] | GA_Eb0025C07f *Gossypium arboreum* 7-10 dna fiber library *Gossypium arboreum* cDNA clone GA_Eb0025C07f, mRNA sequence |
| 831 | G1478 | BG157399 | 6.50E−19 | [*Glycine max*] | sab36g12.y1 Gm-c1026 *Glycine max* cDNA clone GENOME SYSTEMS CLONE ID: Gm-c1026-3791 5- similar to TR:O81834 O81834 HYPOTHETICAL 24.1 KD PROTEIN.;, mRNA sequence |
| 831 | G1478 | C95300 | 2.20E−10 | [*Citrus unshiu*] | C95300 *Citrus unshiu* Miyagawa-wase maturation stage *Citrus unshiu* cDNA clone pcMA1M0912-49 5-, mRNA sequence |
| 831 | G1478 | AW034552 | 2.70E−10 | [*Lycopersicon esculentum*] | EST278168 tomato callus, TAMU *Lycopersicon esculentum* cDNA clone cLEC24E8, mRNA sequence |
| 831 | G1478 | BI070429 | 3.40E−10 | [*Populus tremula x Populus tremuloides*] | C037P68U Populus strain T89 leaves *Populus tremula x Populus tremuloides* cDNA, mRNA sequence |
| 831 | G1478 | AF016011 | 5.10E−09 | [*Brassica napus*] | CONSTANS homolog (Bn9CON10) gene, complete cds |
| 831 | G1478 | BE598912 | 6.20E−09 | [*Sorghum bicolor*] | PI1_84_H11.b1_A002 Pathogen induced 1 (PI1) *Sorghum bicolor* cDNA, mRNA sequence |
| 831 | G1478 | BG605313 | 6.80E−09 | [*Triticum aestivum*] | WHE2331_C04_F07ZS Wheat pre-anthesis cDNA library *Triticum aestivum* cDNA clone WHE2331 C04 F07, mRNA sequence |
| 831 | G1478 | BE558327 | 8.90E−09 | [*Hordeum vulgare*] | HV_CEb0017D19f *Hordeum vulgare* seedling green leaf EST library HVcDNA0005 (Blumeria challenged) *Hordeum vulgare* subsp. *vulgare* cDNA clone HV_CEb0017D19f, mRNA sequence |
| 831 | G1478 | BG647091 | 1.20E−08 | [*Medicago truncatula*] | EST508710 HOGA *Medicago truncatula* cDNA clone pHOGA-15N3 5- end, mRNA sequence |
| 831 | G1478 | gi2895188 | 4.70E−11 | [*Brassica napus*] | CONSTANS homolog [*Brassica napus*] |
| 831 | G1478 | gi3618308 | 1.50E−09 | [*Oryza sativa*] | zinc finger protein [*Oryza sativa Japonica* Group] |
| 831 | G1478 | gi11037308 | 4.70E−09 | [*Brassica nigra*] | constans-like protein [*Brassica nigra*] |
| 831 | G1478 | gi3341723 | 1.30E−08 | [*Raphanus sativus*] | CONSTANS-like 1 protein [*Raphanus sativus*] |
| 831 | G1478 | gi4091806 | 1.50E−07 | [*Malus x domestica*] | CONSTANS-like protein 2 [*Malus x domestica*] |

TABLE 4-continued

Orthologs of *Arabidopsis* sequences

| SEQ ID NO | GID | Test Sequence ID | Smallest Sum Probability | Test Sequence Species | Test Sequence GenBank Annotation |
|---|---|---|---|---|---|
| 831 | G1478 | gi10946337 | 3.10E−07 | [*Ipomoea nil*] | CONSTANS -like protein [*Ipomoea nil*] |
| 831 | G1478 | gi4557093 | 1.40E−05 | [*Pinus radiata*] | zinc finger protein [*Pinus radiata*] |
| 831 | G1478 | gi619312 | 0.9 | [*Capparis masaikai*] | mabinlin III B-chain=sweet protein mabinlin [*Capparis masaikai*, Levi, seeds, Pepti de, 72 aa] |
| 831 | G1478 | gi4732091 | 1 | [*Zea mays*] | bundle sheath defective protein 2 [*Zea mays*] |
| 831 | G1478 | gi4699629 | 1 | [*Nicotiana alata*] | Chain A, Putative Ancestral Protein Encoded By A Single Sequence Repeat Of The Multidomain Proteinase Inhibitor From *Nicotiana Alata* |
| 579 | G681 | BG128147 | 6.80E−41 | [*Lycopersicon esculentum*] | EST473793 tomato shoot/meristem *Lycopersicon esculentum* cDNA clone cTOF19M9 5- sequence, mRNA sequence |
| 579 | G681 | BF054497 | 1.50E−39 | [*Solanum tuberosum*] | EST439727 potato leaves and petioles *Solanum tuberosum* cDNA clone cSTB39N16 5- sequence, mRNA sequence |
| 579 | G681 | BE054276 | 8.40E−39 | [*Gossypium arboreum*] | GA_Ea0002O18f *Gossypium arboreum* 7-10 dpa fiber library Gossypium arboreum cDNA clone GA_Ea0002O18f, mRNA sequence |
| 579 | G681 | BG269414 | 4.00E−38 | [*Mesembryanthem um crystallinum*] | L0-3478T3 Ice plant Lambda Uni-Zap XR expression library, 0 hours NaCl treatment *Mesembryanthemum crystallinum* cDNA clone L0-3478 5-, mRNA sequence |
| 579 | G681 | BF620286 | 7.40E−38 | [*Hordeum vulgare*] | HVSMEc0019F08f *Hordeum vulgare* seedling shoot EST library HVcDNA0003 (Etiolated and unstressed) *Hordeum vulgare* subsp. *vulgare* cDNA clone HVSMEc0019F08f, mRNA sequence |
| 579 | G681 | BE490032 | 1.00E−37 | [*Triticum aestivum*] | WHE0364_C04_E08ZS Wheat cold-stressed seedling cDNA library *Triticum aestivum* cDNA clone WHE0364_C04_E08, mRNA sequence |
| 579 | G681 | BI542536 | 1.40E−36 | [*Zea mays*] | 949021A03.y1 949 - Juvenile leaf and shoot cDNA from Steve Moose Zea mays cDNA, mRNA sequence |
| 579 | G681 | BF425254 | 7.20E−36 | [*Glycine max*] | su42c10.y1 Gm-c1068 *Glycine max* cDNA clone GENOME SYSTEMS CLONE ID: Gm-c1068-2035 5- similar to TR:Q9XFM9 Q9XFM9 MYB-RELATED TRANSCRIPTION FACTOR MIXTA-LIKE 1.;, mRNA sequence |
| 579 | G681 | AW672062 | 3.20E−34 | [*Sorghum bicolor*] | LG1_354_G05.b1_A002 Light Grown 1 (LG1) *Sorghum bicolor* cDNA, mRNA sequence |
| 579 | G681 | BG448527 | 1.00E−33 | [*Medicago truncatula*] | NF036F04RT1F1032 Developing root *Medicago truncatula* cDNA clone NF036F04RT 5-, mRNA sequence |
| 579 | G681 | gi13346188 | 9.10E−37 | [*Gossypium hirsutum*] | GHMYB25 [*Gossypium hirsutum*] |
| 579 | G681 | gi20563 | 6.30E−36 | [*Petunia x hybrida*] | protein 1 [*Petunia x hybrida*] |
| 579 | G681 | gi485867 | 1.20E−34 | [*Antirrhinum majus*] | mixta [*Antirrhinum majus*] |
| 579 | G681 | gi2605617 | 1.70E−32 | [*Oryza sativa*] | OSMYB1 [*Oryza sativa*] |
| 579 | G681 | gi1430846 | 2.00E−31 | [*Lycopersicon esculentum*] | myb-related transcription factor [*Solanum lycopersicum*] |
| 579 | G681 | gi6651292 | 2.20E−30 | [*Pimpinella brachycarpa*] | myb-related transcription factor [*Pimpinella brachycarpa*] |
| 579 | G681 | gi15042116 | 4.90E−30 | [*Zea mays subsp. parviglumis*] | CI protein [*Zea mays* subsp. *parviglumis*] |
| 579 | G681 | gi82730 | 6.10E−30 | [*Zea mays*] | transforming protein (myb) homolog (clone Zm38) - maize |
| 579 | G681 | gi5139806 | 8.30E−30 | [*Glycine max*] | GmMYB29A2 [*Glycine max*] |
| 579 | G681 | gi19055 | 1.10E−29 | [*Hordeum vulgare*] | MybHv5 [*Hordeum vulgare* subsp. *vulgare*] |
| 611 | G878 | AF096299 | 6.20E−90 | [*Nicotiana tabacum*] | DNA-binding protein 2 (WRKY2) mRNA, complete cds |
| 611 | G878 | CUSSLDB | 1.80E−83 | [*Cucumis sativus*] | SPF1-like DNA binding protein mRNA, complete cds |
| 611 | G878 | AF193802 | 3.50E−63 | [*Oryza saliva*] | zinc finger transcription factor WRKY1 mRNA, complete cds |
| 611 | G878 | AX192162 | 2.20E−62 | [*Glycine max*] | Sequence 9 from Patent WO0149840 |
| 611 | G878 | IPBSPFIP | 3.80E−58 | [*Ipomoea batatas*] | Sweet potato mRNA for SPF1 protein, complete cds |

TABLE 4-continued

Orthologs of Arabidopsis sequences

| SEQ ID NO | GID | Test Sequence ID | Smallest Sum Probability | Test Sequence Species | Test Sequence GenBank Annotation |
|---|---|---|---|---|---|
| 611 | G878 | AFABF1 (CAA88326) | 2.00E−56 | [Avena fatua] | A.fatua mRNA for DNA-binding protein (clone ABF1) |
| 611 | G878 | LES303343 | 7.20E−55 | [Lycopersicon esculentum] | Lycopersicon esculentum mRNA for hypothetical protein (ORF1), clone |
| 611 | G878 | AX192164 | 4.00E−54 | [Triticum aestivum] | Sequence 11 from Patent WO0149840. |
| 611 | G878 | AF080595 | 2.10E−53 | [Pimpinella brachycarpa] | zinc finger protein (LFP1) mRNA, complete cds |
| 611 | G878 | PCU48831 | 2.30E−53 | [Petroselinum crispum] | DNA-binding protein WRKY1 mRNA, complete cds |
| 611 | G878 | gi4322940 | 3.30E−128 | [Nicotiana tabacum] | DNA-binding protein 2 [Nicotiana tabacum] |
| 611 | G878 | gi927025 | 1.10E−109 | [Cucumis sativus] | SPF1-like DNA-binding protein [Cucumis sativus] |
| 611 | G878 | gi6689916 | 1.50E−74 | [Oryza sativa] | zinc finger transcription factor WRKY1 [Oryza sativa] |
| 611 | G878 | gi484261 | 1.10E−66 | [Ipomoea batatas] | SPF1 protein [Ipomoea batatas] |
| 611 | G878 | gi1159877 | 2.30E−63 | [Avena fatua] | DNA-binding protein [Avena fatua] |
| 611 | G878 | gi13620227 | 4.60E−63 | [Lycopersicon esculentum] | hypothetical protein [Lycopersicon esculentum] |
| 611 | G878 | gi5917653 | 1.70E−56 | [Petroselinum crispum] | zinc-finger type transcription factor WRKY1 [Petroselinum crispum] |
| 611 | G878 | gi4894965 | 5.00E−56 | [Avena sativa] | DNA-binding protein WRKY1 [Avena sativa] |
| 611 | G878 | gi3420906 | 8.70E−56 | [Pimpinella brachycarpa] | zinc finger protein; WRKY1 [Pimpinella brachycarpa] |
| 611 | G878 | gi13620168 | 4.20E−22 | [Capsella rubella] | hypothetical protein [Capsella rubella] |
| 47 | G374 | AP004457 | 1.20E−73 | [Oryza sativa (japonica cultivar-GROUP)] | Oryza sativa (japonica cultivar-group) chromosome 8 clone P00131304, *** SEQUENCING IN PROGRESS *** |
| 47 | G374 | AP004693 | 1.90E−73 | [Oryza sativa] | chromosome 8 clone P0461F06, *** SEQUENCING IN PROGRESS *** |
| 47 | G374 | BH552835 | 1.30E−62 | [Brassica oleracea] | BOHGT56TR BOHG Brassica oleracea genomic clone BOHGT56, genomic survey sequence |
| 47 | G374 | BG128229 | 6.50E−55 | [Lycopersicon esculentum] | EST473875 tomato shoot/meristem Lycopersicon esculentum cDNA clone cTOF19M22 5- sequence, mRNA sequence |
| 47 | G374 | BG646959 | 3.20E−46 | [Medicago truncatula] | EST508578 HOGA Medicago truncatula cDNA clone pHOGA-15E4 5- end, mRNA sequence |
| 47 | G374 | BG890162 | 8.70E−41 | [Solanum tuberosum] | EST516013 cSTD Solanum tuberosum cDNA clone cSTD17K24 5- sequence, mRNA sequence |
| 47 | G374 | AW179366 | 6.00E−38 | [Zea mays] | 618046G06.y1 618 - Inbred Tassel cDNA Library Zea mays cDNA, mRNA sequence GenBank: AW179366.1 |
| 47 | G374 | BF473206 | 1.50E−32 | [Triticum aestivum] | WHE0922_G12_M24ZS Wheat 5-15 DAP spike cDNA library Triticum aestivum cDNA clone WHE0922 G12 M24. mRNA sequence |
| 47 | G374 | AW761011 | 2.90E−29 | [Glycine max] | s161g11.y1 Gm-c1027 Glycine max cDNA clone GENOME SYSTEMS CLONE ID: Gm-c1027-5853 5- similar to SW:ZPR1 SCHPO O13724 ZINC-FINGER PROTEIN ZPR1.;, mRNA sequence |
| 47 | G374 | AJ436050 | 1.50E−27 | [Hordeum vulgare] | AJ436050 S00007 Hordeum vulgare cDNA clone S0000700028G09F1, mRNA sequence |
| 47 | G374 | gi422012 | 0.8 | [Sorghum bicolor] | lipid transfer protein - sorghum (fragment) |
| 47 | G374 | gi1827893 | 1 | [Zea mays] | Maize Nonspecific Lipid Transfer Protein Complexed With Palmitate |

The invention thus provides for methods for preparing transgenic plants, and for modifying plant traits. These methods include introducing into a plant a recombinant expression vector or cassette comprising a functional promoter operably linked to one or more sequences homologous to presently disclosed sequences. Plants and kits for producing these plants that result from the application of these methods are also encompassed by the present invention.

Traits of Interest

Examples of some of the traits that may be desirable in plants, and that may be provided by transforming the plants with the presently disclosed sequences, are listed in Table 5 and 6. The listed traits are altered relative to control plants.

TABLE 5

Genes, traits, transcription factor families and conserved domains

| Poly-nucleotide SEQ ID NO: | GID No. | Trait | Category | Family | Comment | Poly-peptide SEQ ID NO: | Conserved domains |
|---|---|---|---|---|---|---|---|
| 1 | G1275 | Architecture; size | Dev and morph | WRKY | Reduced apical dominance; small plant | 2 | (113-169) |
| 3 | G1411 | Architecture | Dev and morph | AP2 | Loss of apical dominance | 4 | (87-154) |
| 5 | G1488 | Architecture; light response; size; seed protein content | Dev and morph; seed biochemistry | GATA/Zn | Reduced apical dominance, shorter stems; constitutive photomorphogenesis; reduced size; altered seed protein content | 6 | (221-246) |
| 7 | G1499 | Architecture; flower; morphology: other | Dev and morph | HLH/MYC | Altered plant architecture; altered floral organ identity and development; dark green color | 8 | (118-181) |
| 9 | G1543 | Architecture; flower; morphology: other; seed oil | Dev and morph; seed biochemistry | HB | Altered plant architecture; altered carpel shape; dark green color; decreased seed oil | 10 | (135-195) |
| 11 | G1635 | Architecture; morphology: other; fertility | Dev and morph | MYB-related | Reduced apical dominance; pale green, smaller plants; reduced fertility | 12 | (44-104) |
| 13 | G1794 | Architecture; light response; seed oil and protein content | Dev and morph; seed biochemistry | AP2 | Altered plant architecture; constitutive photomorphogenesis; altered seed oil and protein content | 14 | (182-248) |
| 15 | G1839 | Architecture; size | Dev and morph | AP2 | Altered plant architecture; reduced size | 16 | (118-184) |
| 17 | G2108 | Architecture | Dev and morph | AP2 | Altered inflorescence structure | 18 | (18-85) |
| 19 | G2291 | Architecture; flowering time | Dev and morph; flowering time | AP2 | Altered plant architecture; late flowering | 20 | (TBD) |
| 21 | G2452 | Architecture; leaf | Dev and morph | MYB-related | Reduced apical dominance; pale green color | 22 | (27-213) |
| 23 | G2509 | Architecture; seed oil and protein content | Dev and morph; seed biochemistry | AP2 | Reduced apical dominance; altered seed oil and protein content | 24 | (89-156) |
| 25 | G390 | Architecture | Dev and morph | HB | Altered shoot development | 26 | (18-81) |
| 27 | G391 | Architecture | Dev and morph | HB | Altered shoot development | 28 | (25-85) |
| 29 | G438 | Architecture; stem | Dev and morph | HB | Reduced branching; reduced lignin | 30 | (22-85) |
| 31 | G47 | Architecture; stem; flowering time; altered seed oil content | Dev and morph; flowering time; seed biochemistry | AP2 | Altered architecture and inflorescence development, structure of vascular tissues; late flowering; altered seed oil content | 32 | (11-80) |
| 33 | G559 | Architecture; fertility | Dev and morph | bZIP | Loss of apical dominance; reduced fertility | 34 | (203-264) |
| 35 | G568 | Architecture; flowering time | Dev and morph; flowering time | bZIP | Altered branching; late flowering | 36 | (215-265) |
| 37 | G580 | Architecture; flower | Dev and morph | bZIP | Altered inflorescences; altered flower development | 38 | (162-218) |
| 39 | G615 | Architecture; fertility | Dev and morph | TEO | Altered plant architecture; little or no pollen production, | 40 | (88-147) |

TABLE 5-continued

Genes, traits, transcription factor families and conserved domains

| Poly-nucleotide SEQ ID NO: | GID No. | Trait | Category | Family | Comment | Poly-peptide SEQ ID NO: | Conserved domains |
|---|---|---|---|---|---|---|---|
| 41 | G732 | Architecture; flower; seed oil and protein content | Dev and morph; seed biochemistry | bZIP | poor filament elongation Reduced apical dominance; abnormal flowers; altered seed oil and protein content | 42 | (31-91) |
| 43 | G988 | Architecture; fertility; flower; stem; seed oil and protein content | Dev and morph; seed biochemistry | SCR | Reduced lateral branching; reduced fertility; enlarged floral organs, short pedicels; thicker stem, altered distribution of vascular bundles; altered seed oil and protein content | 44 | (178-195) |
| 45 | G1519 | Embryo lethal | Dev and morph | RING/C3HC4 | Embryo lethal | 46 | (327-364) |
| 47 | G374 | Embryo lethal | Dev and morph | Z-ZPF | Embryo lethal | 48 | (35-67, 245-277) |
| 49 | G877 | Embryo lethal | Dev and morph | WRKY | Embryo lethal | 50 | (272-328, 487-603) |
| 51 | G1000 | Fertility; size; flower; stem | Dev and morph | MYB-(R1)R2R3 | Reduced fertility; small plant; reduced or absent petals and sepals; reduced inflorescence, stem elongation | 52 | (14-117) |
| 53 | G1067 | Fertility; leaf; size | Dev and morph | AT-hook | Reduced fertility; altered leaf shape; small plant | 54 | (86-93) |
| 55 | G1075 | Fertility; flower; leaf; size | Dev and morph | AT-hook | Reduced fertility; reduced or absent petals, sepals and stamens; altered leaf shape; small plant | 56 | (78-85) |
| 57 | G1266 | Fertility; size | Dev and morph | AP2 | Reduced fertility; small plant | 58 | (79-147) |
| 59 | G1311 | Fertility; size | Dev and morph | MYB-(R1)R2R3 | Reduced fertility; small plant | 60 | (11-112) |
| 61 | G1321 | Fertility; flower | Dev and morph | MYB-(R1)R2R3 | Poor fertility; altered flower morphology | 62 | (4-106) |
| 63 | G1326 | Fertility; flower; size | Dev and morph | MYB-(R1)R2R3 | Reduced fertility; petals and sepals are smaller; small plant | 64 | (18-121) |
| 65 | G1367 | Fertility; size | Dev and morph | AT-hook | Reduced fertility; reduced size | 66 | (179-201, 262-285, 298-319, 335-357) |
| 67 | G1386 | Fertility; size; seed oil and protein content | Dev and morph; seed biochemistry | AP2 | Reduced fertility; reduced size; altered seed oil and protein content | 68 | (TBD) |
| 69 | G1421 | Fertility; size; seed oil content | Dev and morph; seed biochemistry | AP2 | Reduced fertility; small plant; altered seed oil content | 70 | (74-151) |
| 71 | G1453 | Fertility; morphology: other | Dev and morph | NAC | Reduced fertility; altered inflorescence development | 72 | (13-160) |
| 73 | G1560 | Fertility; flower; size | Dev and morph | HS | Reduced fertility; altered flower development; reduced size | 74 | (62-151) |
| 75 | G1594 | Fertility; leaf; seed | Dev and morph | HB | Reduced fertility; altered leaf shape and development; large pale seed | 76 | (343-308) |
| 77 | G1750 | Fertility; size; seed oil content | Dev and morph; seed biochemistry | AP2 | Reduced fertility; reduced size; increased seed oil content | 78 | (107-173) |

TABLE 5-continued

Genes, traits, transcription factor families and conserved domains

| Poly-nucleotide SEQ ID NO: | GID No. | Trait | Category | Family | Comment | Polypeptide SEQ ID NO: | Conserved domains |
|---|---|---|---|---|---|---|---|
| 79 | G1947 | Fertility; flower; seed protein content | Dev and morph; seed biochemistry | HS | Reduced fertility; extended period of flowering; altered seed protein content | 80 | (37-120) |
| 81 | G2011 | Fertility; size; seed oil and protein content | Dev and morph; seed biochemistry | HS | Reduced fertility; reduced size; altered seed oil and protein content | 82 | (56-147) |
| 83 | G2094 | Fertility; leaf; size | Dev and morph | GATA/Zn | Reduced fertility; altered leaf development; reduced size | 84 | (43-68) |
| 85 | G2113 | Fertility; leaf; seed protein content | Dev and morph; seed biochemistry | AP2 | Reduced fertility; long petioles, altered orientation; altered seed protein content | 86 | (TBD) |
| 87 | G2115 | Fertility; size | Dev and morph | AP2 | Reduced fertility; reduced size | 88 | (46-115) |
| 89 | G2130 | Fertility; size; senescence | Dev and morph | AP2 | Reduced fertility; reduced size; early senescence | 90 | (93-160) |
| 91 | G2147 | Fertility; size | Dev and morph | HLH/MYC | Reduced fertility; reduced size | 92 | (160-234) |
| 93 | G2156 | Fertility; size; seed protein content | Dev and morph; seed biochemistry | AT-hook | Reduced fertility; reduced size; altered seed protein content | 94 | (66-86) |
| 95 | G2294 | Fertility; size | Dev and morph | AP2 | Reduced fertility; reduced size | 96 | (32-102) |
| 97 | G2510 | Fertility; size | Dev and morph | AP2 | Reduced fertility; reduced size | 98 | (41-108) |
| 99 | G2893 | Fertility; flower; size | Dev and morph | MYB-(R1)R2R3 | Reduced fertility; altered flower development; reduced size | 100 | (19-120) |
| 101 | G340 | Fertility; size | Dev and morph | Z-C3H | Reduced fertility, size | 102 | (37-154) |
| 103 | G39 | Fertility; size | Dev and morph | AP2 | Reduced fertility, small plant | 104 | (24-90) |
| 105 | G439 | Fertility; size | Dev and morph | AP2 | Reduced fertility; small plant | 106 | (110-177) |
| 107 | G470 | Fertility | Dev and morph | ARF | Short stamen filaments | 108 | (61-393) |
| 109 | G652 | Fertility; seed; flower; size; seed oil content | Dev and morph; seed biochemistry | Z-CLDSH | Reduced fertility; irregular shaped seed; altered flower development; reduced size, slow growth; altered seed oil content | 110 | (28-49, 137-151, 182-196) |
| 111 | G671 | Fertility; flower; leaf; size; stem | Dev and morph | MYB-(R1)R2R3 | Reduced fertility; reduced petal abscission; altered leaf shape; small plant; altered inflorescence stem structure | 112 | (15-115) |
| 113 | G779 | Fertility; flower | Dev and morph | HLH/MYC | Reduced fertility, homeotic transformations | 114 | (126-182) |
| 115 | G962 | Fertility; size | Dev and morph | NAC | Reduced fertility; small plant | 116 | (53-175) |
| 117 | G977 | Fertility; leaf; morphology: other; size | Dev and morph | AP2 | Reduced fertility; altered leaf shape; dark green; small plant | 118 | (5-72) |
| 119 | G1063 | Flower; leaf; inflorescence; seed oil and protein content | Dev and morph; seed biochemistry | HLH/MYC | Altered flower development, ectopic carpel tissue; altered leaf shape, dark green color; altered inflorescence development; altered seed oil and protein content | 120 | (131-182) |

TABLE 5-continued

Genes, traits, transcription factor families and conserved domains

| Polynucleotide SEQ ID NO: | GID No. | Trait | Category | Family | Comment | Polypeptide SEQ ID NO: | Conserved domains |
|---|---|---|---|---|---|---|---|
| 121 | G1140 | Flower | Dev and morph | MADS | Altered flower development | 122 | (2-57) |
| 123 | G1425 | Flower | Dev and morph | NAC | Altered flower and inflorescence development | 124 | (20-173) |
| 125 | G1449 | Flower | Dev and morph | IAA | Altered flower structure | 126 | (48-53, 74-107, 122-152) |
| 127 | G1897 | Flower; leaf; seed protein content | Dev and morph; seed biochemistry | Z-Dof | Altered flower development; altered leaf development; altered seed protein content | 128 | (34-62) |
| 129 | G2143 | Flower; leaf; inflorescence | Dev and morph | HLH/MYC | Altered flower development, ectopic carpel tissue; altered leaf shape, dark green color; altered inflorescence development | 130 | (128-179) |
| 131 | G2535 | Flower; seed protein content | Dev and morph; seed biochemistry | NAC | Altered flower development; altered seed protein content | 132 | (11-114) |
| 133 | G2557 | Flower; leaf | Dev and morph | HLH/MYC | Altered flower development, ectopic carpel tissue; altered leaf shape, dark green color | 134 | (278-328) |
| 135 | G259 | Flower; leaf | Dev and morph | HS | Altered flower development; altered leaf development | 136 | (27-131) |
| 137 | G353 | Flower; leaf; size; seed protein content | Dev and morph; seed biochemistry | Z-C2H2 | Short pedicels, downward pointing siliques; altered leaf development; reduced size; altered seed protein content | 138 | (41-61, 84-104) |
| 139 | G354 | Flower; light response; size | Dev and morph | Z-C2H2 | Short pedicels, downward pointing siliques; constitutive morphogenesis; reduced size | 140 | (42-62, 88-109) |
| 141 | G638 | Flower; morphology: other | Dev and morph | TH | Altered flower development; multiple developmental defects | 142 | (119-206) |
| 143 | G869 | Flower; morphology: other; seed oil | Dev and morph; seed biochemistry | AP2 | Abnormal anther development; small and spindly plant; altered seed fatty acids | 144 | (109-177) |
| 145 | G1645 | Inflorescence; leaf | Dev and morph | MYB-(R1)R2R3 | Altered inflorescence structure; altered leaf development | 146 | (90-210) |
| 147 | G1038 | Leaf | Dev and morph | GARP | Altered leaf shape | 148 | (198-247) |
| 149 | G1073 | Leaf; size; flowering time | Dev and morph; flowering time | AT-hook | Serrated leaves; increased plant size; flowering appears to be slightly delayed | 150 | (33-42, 78-175) |
| 151 | G1146 | Leaf | Dev and morph | PAZ | Altered leaf development | 152 | (886-896) |
| 153 | G1267 | Leaf; size | Dev and morph | WRKY | Dark green shiny leaves; small plant | 154 | (70-127) |
| 155 | G1269 | Leaf | Dev and morph | MYB-related | Long petioles, upturned leaves | 156 | (27-83) |
| 157 | G1452 | Leaf; trichome; flowering time | Dev and morph; flowering time | NAC | Altered leaf shape, dark green color; reduced trichome density; late flowering | 158 | (30-177) |
| 159 | G1494 | Leaf; size; light response; seed | Dev and morph | HLH/MYC | Pale green leaves, altered leaf shape; reduced size; long hypocotyls; large, pale seeds | 160 | (261-311) |

TABLE 5-continued

Genes, traits, transcription factor families and conserved domains

| Poly-nucleotide SEQ ID NO: | GID No. | Trait | Category | Family | Comment | Poly-peptide SEQ ID NO: | Conserved domains |
|---|---|---|---|---|---|---|---|
| 161 | G1548 | Leaf | Dev and morph | HB | Altered leaf development | 162 | (17-77) |
| 163 | G1574 | Leaf | Dev and morph | SWI/SNF | Altered leaf development | 164 | (28-350) |
| 165 | G1586 | Leaf; size | Dev and morph | HB | Narrow leaves; small plants | 166 | (21-81) |
| 167 | G1786 | Leaf; light response; size | Dev and morph | MYB-(R1)R2R3 | Dark green, small leaves with short petioles; photomorphogenesis in the dark; small plant | 168 | (TBD) |
| 169 | G1792 | Leaf; seed oil and protein content | Dev and morph; seed biochemistry | AP2 | Dark green, shiny leaves; altered seed oil and protein content | 170 | (17-85) |
| 171 | G1865 | Leaf; seed oil and protein content | Dev and morph; seed biochemistry | GRF-like | Altered leaf development; altered seed oil and protein content | 172 | (124-149) |
| 173 | G1886 | Leaf; size | Dev and morph | Z-Dof | Chlorotic patches in leaves; reduced size | 174 | (17-59) |
| 175 | G1933 | Leaf; size; seed protein content | Dev and morph; seed biochemistry | WRKY | Altered leaf development; reduced size; altered seed protein content | 176 | (205-263, 344-404) |
| 177 | G2059 | Leaf; seed oil and protein content | Dev and morph; seed biochemistry | AP2 | Smaller, curled leaves; altered seed oil, protein content | 178 | (184-254) |
| 179 | G2105 | Leaf; seed | Dev and morph | TH | Alterations in leaf surface; large, pale seeds | 180 | (100-153) |
| 181 | G2117 | Leaf; seed oil and protein content | Dev and morph; seed biochemistry | bZIP | Small, dark green leaves; altered seed oil and protein content | 182 | (46-106) |
| 183 | G2124 | Leaf; seed protein content | Dev and morph; seed biochemistry | TEO | Altered leaf development; altered seed protein content | 184 | (75-132) |
| 185 | G2140 | Leaf; root | Dev and morph | HLH/MYC | Altered leaf development; short roots | 186 | (167-242) |
| 187 | G2144 | Leaf; light response; size; seed oil content | Dev and morph; seed biochemistry | HLH/MYC | Pale green leaves, altered leaf shape; long hypocotyls; reduced size; altered seed oil content | 188 | (203-283) |
| 189 | G2431 | Leaf | Dev and morph | GARP | Dark green leaves; reduced size | 190 | (38-88) |
| 191 | G2465 | Morphology: other; leaf | Dev and morph | GARP | Slowed development; altered leaf color and shape | 192 | (219-269) |
| 193 | G2583 | Leaf; seed oil and protein content | Dev and morph; seed biochemistry | AP2 | Glossy, shiny leaves; altered seed oil and protein content | 194 | (4-71) |
| 195 | G2724 | Leaf | Dev and morph | MYB-(R1)R2R3 | Dark green leaves | 196 | (7-113) |
| 197 | G377 | Leaf; morphology: other | Dev and morph | RING/C3H2C3 | Altered leaf development; slow growth | 198 | (85-128) |
| 199 | G428 | Leaf | Dev and morph | HB | Altered leaf shape | 200 | (229-292) |
| 201 | G447 | Leaf; morphology: other; size | Dev and morph | ARF | Dark green leaves; altered cotyledon shape; reduced size | 202 | (22-356) |
| 203 | G464 | Leaf | Dev and morph | IAA | Altered leaf shape | 204 | (20-28, 71-82, 126-142, 187-224) |
| 205 | G557 | Leaf; size | Dev and morph | bZIP | Dark green color; small plant | 206 | (90-150) |
| 207 | G577 | Leaf | Dev and morph | BZIPT2 | Reduced size, increased anthocyanins | 208 | (TBD) |

TABLE 5-continued

Genes, traits, transcription factor families and conserved domains

| Poly-nucleotide SEQ ID NO: | GID No. | Trait | Category | Family | Comment | Poly-peptide SEQ ID NO: | Conserved domains |
|---|---|---|---|---|---|---|---|
| 209 | G674 | Leaf; size | Dev and morph | MYB-(R1)R2R3 | Dark green leaves, upwardly oriented; reduced size | 210 | (20-120) |
| 211 | G736 | Leaf; flowering time | Dev and morph; flowering time | Z-Dof | Altered leaf shape; later flowering | 212 | (54-111) |
| 213 | G903 | Leaf | Dev and morph | Z-C2H2 | Altered leaf morphology | 214 | (68-92) |
| 215 | G917 | Leaf; seed oil and protein content | Dev and morph; seed biochemistry | MADS | Altered leaf development; altered seed oil and protein content | 216 | (2-57) |
| 217 | G921 | Leaf | Dev and morph | WRKY | Serrated leaves | 218 | (146-203) |
| 219 | G922 | Leaf; size | Dev and morph | SCR | Altered development, dark green color; reduced size | 220 | (225-242) |
| 221 | G932 | Leaf; size | Dev and morph | MYB-(R1)R2R3 | Altered development, dark green color; reduced size | 222 | (12-118) |
| 223 | G599 | Leaf; size | Dev and morph | DBP | Altered leaf shape; small plant | 224 | (187-219, 264-300) |
| 225 | G804 | Leaf; size | Dev and morph | PCF | Altered leaf shape, small plant | 226 | (54-117) |
| 227 | G1062 | Light response; morphology; other; seed | Dev and morph | HLH/MYC | Constitutive photomorphogenesis; slow growth; altered seed shape | 228 | (308-359) |
| 229 | G1322 | Light response; size | Dev and morph | MYB-(R1)R2R3 | Photomorphogenesis in the dark; reduced size | 230 | (26-130) |
| 231 | G1331 | Light response; morphology: other; seed oil and protein content | Dev and morph; seed biochemistry | MYB-(R1)R2R3 | Constitutive photomorphogenesis; multiple developmental alterations; altered seed oil and protein content | 232 | (8-109) |
| 233 | G1521 | Light response | Dev and morph | RING/C3HC4 | Constitutive photomorphogenesis | 234 | (39-80) |
| 235 | G183 | Light response; seed protein content | Dev and morph; seed biochemistry | WRKY | Constitutive photomorphogenesis; altered seed protein content | 236 | (307-363) |
| 237 | G2555 | Light response | Dev and morph | HLH/MYC | Constitutive photomorphogenesis | 238 | (175-245) |
| 239 | G375 | Light response | Dev and morph | Z-Dof | Upward pointing leaves | 240 | (75-103) |
| 241 | G1007 | Morphology: other | Dev and morph | AP2 | Multiple developmental alterations | 242 | (TBD) |
| 243 | G1010 | Morphology: other | Dev and morph | ABI3/VP-1 | Multiple developmental alterations | 244 | (33-122) |
| 245 | G1014 | Morphology: other; trichome | Dev and morph | ABI3/VP-1 | Multiple developmental defects; reduced trichomes | 246 | (90-172) |
| 247 | G1035 | Morphology: other | Dev and morph | bZIP | Multiple developmental alterations | 248 | (39-91) |
| 249 | G1046 | Morphology: other | Dev and morph | bZIP | Multiple developmental alterations | 250 | (79-138) |
| 251 | G1049 | Morphology: other; seed protein content | Dev and morph; seed biochemistry | bZIP | Multiple developmental alterations; altered seed protein content | 252 | (77-132) |
| 253 | G1069 | Morphology: other; seed oil content | Dev and morph; seed biochemistry | AT-hook | Multiple developmental alterations; altered seed oil content | 254 | (67-74) |

TABLE 5-continued

Genes, traits, transcription factor families and conserved domains

| Poly-nucleotide SEQ ID NO: | GID No. | Trait | Category | Family | Comment | Poly-peptide SEQ ID NO: | Conserved domains |
|---|---|---|---|---|---|---|---|
| 255 | G1070 | Morphology: other | Dev and morph | AT-hook | Several developmental defects | 256 | (98-120) |
| 257 | G1076 | Morphology: other | Dev and morph | AT-hook | Lethal when overexpressed | 258 | (82-89) |
| 259 | G1089 | Morphology: other | Dev and morph | BZIPT2 | Developmental defects at seedling stage | 260 | (425-500) |
| 261 | G1093 | Morphology: other | Dev and morph | RING/C3H2C3 | Multiple morphological alterations | 262 | (105-148) |
| 263 | G1127 | Morphology: other | Dev and morph | AT-hook | Multiple developmental alterations | 264 | (103-110, 155-162) |
| 265 | G1131 | Morphology: other; seed protein content | Dev and morph; seed biochemistry | HLH/MYC | Multiple developmental alterations; altered seed protein content | 266 | (173-220) |
| 267 | G1145 | Morphology: other; seed oil and protein content | Dev and morph; seed biochemistry | bZIP | Multiple developmental alterations; reduced seed size, altered seed shape; altered seed oil and protein content | 268 | (227-270) |
| 269 | G1229 | Morphology: other; seed oil and protein content | Dev and morph; seed biochemistry | HLH/MYC | Several developmental defects; altered seed oil and protein content | 270 | (102-160) |
| 271 | G1246 | Morphology: other; seed protein content | Dev and morph; seed biochemistry | MYB-(R1)R2R3 | Multiple developmental alterations; altered seed protein content | 272 | (27-139) |
| 273 | G1255 | Morphology: other; seed | Dev and morph | Z-CO-like | Reduced apical dominance; increased seed size | 274 | (18-56) |
| 275 | G1304 | Morphology: other | Dev and morph | MYB-(R1)R2R3 | Lethal when overexpressed | 276 | (13-118) |
| 277 | G1318 | Morphology: other | Dev and morph | MYB-(R1)R2R3 | Multiple developmental alterations | 278 | (20-123) |
| 279 | G1320 | Morphology: other | Dev and morph | MYB-(R1)R2R3 | Multiple developmental alterations | 280 | (5-108) |
| 281 | G1330 | Morphology: other | Dev and morph | MYB-(R1)R2R3 | Multiple developmental alterations | 282 | (28-134) |
| 283 | G1352 | Morphology: other | Dev and morph | Z-C2H2 | Multiple developmental alterations | 284 | (108-129, 167-188) |
| 285 | G1354 | Morphology: other | Dev and morph | NAC | Multiple developmental alterations | 286 | (TBD) |
| 287 | G1360 | Morphology: other | Dev and morph | NAC | Lethal when overexpressed | 288 | (18-174) |
| 289 | G1364 | Morphology: other | Dev and morph | CAAT | Lethal when overexpressed | 290 | (29-120) |
| 291 | G1379 | Morphology: other | Dev and morph | AP2 | Multiple developmental alterations | 292 | (18-85) |
| 293 | G1384 | Morphology: other | Dev and morph | AP2 | Abnormal inflorescence and flower development | 294 | (TBD) |
| 295 | G1399 | Morphology: other | Dev and morph | AT-hook | Multiple developmental alterations | 296 | (86-93) |
| 297 | G1415 | Morphology: other | Dev and morph | AP2 | Multiple developmental alterations | 298 | (TBD) |
| 299 | G1417 | Morphology: other; seed oil | Dev and morph; seed biochemistry | WRKY | Reduced seedling germination and vigor; increase in 18:2, decrease in 18:3 | 300 | (239-296) |

TABLE 5-continued

Genes, traits, transcription factor families and conserved domains

| Poly-nucleotide SEQ ID NO: | GID No. | Trait | Category | Family | Comment | Polypeptide SEQ ID NO: | Conserved domains |
|---|---|---|---|---|---|---|---|
| 301 | G1442 | Morphology: other | Dev and morph | GRF-like | Multiple developmental alterations | 302 | (172-223) |
| 303 | G1454 | Morphology: other; seed oil and protein content | Dev and morph; seed biochemistry | NAC | Multiple developmental alterations; altered seed oil and protein content | 304 | (9-178) |
| 305 | G1459 | Morphology: other | Dev and morph | NAC | Multiple developmental alterations | 306 | (10-152) |
| 307 | G1460 | Morphology: other; seed protein content | Dev and morph; seed biochemistry | NAC | Multiple developmental alterations; altered seed protein content | 308 | (TBD) |
| 309 | G147 | Morphology: other | Dev and morph | MADS | Multiple developmental defects | 310 | (2-57) |
| 311 | G1471 | Morphology: other; seed oil | Dev and morph; seed biochemistry | Z-C2H2 | Multiple developmental alterations; increased seed oil content | 312 | (49-70) |
| 313 | G1475 | Morphology: other | Dev and morph | Z-C2H2 | Multiple developmental alterations | 314 | (51-73) |
| 315 | G1477 | Morphology: other | Dev and morph | Z-C2H2 | Multiple developmental alterations | 316 | (29-48) |
| 317 | G1487 | Morphology: other; seed oil and protein content | Dev and morph: seed biochemistry | GATA/Zn | Multiple developmental alterations; altered seed oil and protein content | 318 | (251-276) |
| 319 | G1492 | Morphology: other | Dev and morph | GARP | Multiple developmental alterations | 320 | (34-83) |
| 321 | G1531 | Morphology: other; seed; seed protein content | Dev and morph; seed biochemistry | RING/C3HC4 | Multiple developmental alterations; pale seed; altered seed protein content | 322 | (41-77) |
| 323 | G1540 | Morphology: other | Dev and morph | HB | Reduced cell differentiation in meristem | 324 | (35-98) |
| 325 | G1544 | Morphology: other | Dev and morph | HB | Multiple developmental alterations | 326 | (64-124) |
| 327 | G156 | Morphology: other; seed | Dev and morph | MADS | Multiple developmental defects; seed color alteration | 328 | (2-57) |
| 329 | G1584 | Morphology: other | Dev and morph | HB | Multiple developmental alterations | 330 | (TBD) |
| 331 | G1587 | Morphology: other | Dev and morph | HB | Multiple developmental alterations | 332 | (61-121) |
| 333 | G1588 | Morphology: other | Dev and morph | HB | Multiple developmental alterations | 334 | (66-124) |
| 335 | G1589 | Morphology: other; seed protein content | Dev and morph; seed biochemistry | HB | Multiple developmental alterations; altered seed protein content | 336 | (384-448) |
| 337 | G160 | Morphology: other | Dev and morph | MADS | Multiple developmental defects | 338 | (7-62) |
| 339 | G1636 | Morphology: other | Dev and morph | MYB-related | Pale green, smaller plants | 340 | (100-165) |
| 341 | G1642 | Morphology: other | Dev and morph | MYB-(R1)R2R3 | Multiple developmental alterations | 342 | (TBD) |
| 343 | G1747 | Morphology: other; seed | Dev and morph; seed | MYB-(R1)R2R3 | Multiple developmental | 344 | (11-114) |

TABLE 5-continued

Genes, traits, transcription factor families and conserved domains

| Poly- nucleotide SEQ ID NO: | GID No. | Trait | Category | Family | Comment | Poly- peptide SEQ ID NO: | Conserved domains |
|---|---|---|---|---|---|---|---|
| 345 | G1749 | protein content Morphology: other | biochemistry Dev and morph | AP2 | alterations; altered seed protein content Multiple developmental alterations; formation of necrotic lesions | 346 | (84-155) |
| 347 | G1751 | Morphology: other | Dev and morph | AP2 | Multiple developmental alterations | 348 | (TBD) |
| 349 | G1752 | Morphology: other | Dev and morph | AP2 | Multiple developmental alterations | 350 | (83-151) |
| 351 | G1763 | Morphology: other | Dev and morph | AP2 | Lethal when overexpressed | 352 | (140-209) |
| 353 | G1766 | Morphology: other | Dev and morph | NAC | Multiple developmental alterations | 354 | (10-153) |
| 355 | G1767 | Morphology: other; seed oil content | Dev and morph; seed biochemistry | SCR | Multiple developmental alterations; altered seed oil content | 356 | (255-272) |
| 357 | G1778 | Morphology: other | Dev and morph | GATA/Zn | Lethal when overexpressed | 358 | (94-119) |
| 359 | G1789 | Morphology: other; seed protein content | Dev and morph; seed biochemistry | MYB- related | Delayed development; altered seed protein content | 360 | (1-50) |
| 361 | G1790 | Morphology: other | Dev and morph | MYB- (R1)R2R3 | Lethal when overexpressed | 362 | (217-316) |
| 363 | G1791 | Morphology: other | Dev and morph | AP2 | Multiple developmental alterations | 364 | (TBD) |
| 365 | G1793 | Morphology: other; seed oil | Dev and morph; seed biochemistry | AP2 | Multiple developmental alterations; increased seed oil content | 366 | (179-255, 281-349) |
| 367 | G1795 | Morphology: other; trichome | Dev and morph | AP2 | Multiple developmental alterations; reduced trichomes | 368 | (12-80) |
| 369 | G1800 | Morphology: other | Dev and morph | AP2 | Multiple developmental alterations | 370 | (TBD) |
| 371 | G1806 | Morphology: other | Dev and morph | bZIP | Multiple developmental alterations | 372 | (165-225) |
| 373 | G1811 | Morphology: other | Dev and morph | ABI3/VP-1 | Multiple developmental alterations | 374 | (TBD) |
| 375 | G182 | Morphology: other | Dev and morph | WRKY | Multiple developmental alterations | 376 | (217-276) |
| 377 | G1835 | Morphology: other | Dev and morph | GATA/Zn | Small, spindly plant | 378 | (224-296) |
| 379 | G1836 | Morphology: other | Dev and morph | CAAT | Pale green | 380 | (30-164) |
| 381 | G1838 | Morphology: other; seed oil content | Dev and morph; seed biochemistry | AP2 | Multiple developmental alterations; increased seed oil content | 382 | (229-305, 330-400) |
| 383 | G1843 | Morphology: other | Dev and morph | MADS | Multiple developmental alterations | 384 | (2-57) |
| 385 | G1853 | Morphology: other | Dev and morph | AKR | Lethal when overexpressed | 386 | (entire protein) |
| 387 | G1855 | Morphology: other | Dev and morph | AKR | Slow growth | 388 | (entire protein) |
| 389 | G187 | Morphology: other | Dev and morph | WRKY | Variety of morphological alterations | 390 | (172-228) |

TABLE 5-continued

Genes, traits, transcription factor families and conserved domains

| Poly-nucleotide SEQ ID NO: | GID No. | Trait | Category | Family | Comment | Poly-peptide SEQ ID NO: | Conserved domains |
|---|---|---|---|---|---|---|---|
| 391 | G1881 | Morphology: other | Dev and morph | Z-CO-like | Multiple developmental alterations | 392 | (5-28, 56-79) |
| 393 | G1882 | Morphology: other | Dev and morph | Z-Dof | Lethal when overexpressed | 394 | (97-125) |
| 395 | G1883 | Morphology: other | Dev and morph | Z-Dof | Multiple developmental alterations | 396 | (82-124) |
| 397 | G1884 | Morphology: other | Dev and morph | Z-Dof | Multiple developmental alterations | 398 | (43-71) |
| 399 | G1891 | Morphology: other | Dev and morph | Z-Dof | Multiple developmental alterations | 400 | (27-69) |
| 401 | G1896 | Morphology: other | Dev and morph | Z-Dof | Multiple developmental alterations | 402 | (43-85) |
| 403 | G1898 | Morphology: other | Dev and morph | Z-Dof | Lethal when overexpressed | 404 | (31-59) |
| 405 | G1902 | Morphology: other; seed oil content | Dev and morph; seed biochemistry | Z-Dof | Multiple developmental alterations; increased seed oil content | 406 | (31-59) |
| 407 | G1904 | Morphology: other | Dev and morph | Z-Dof | Multiple developmental alterations | 408 | (53-95) |
| 409 | G1906 | Morphology: other | Dev and morph | Z-Dof | Multiple developmental alterations | 410 | (19-47) |
| 411 | G1913 | Morphology: other | Dev and morph | Z-Dof | Lethal when overexpressed | 412 | (27-55) |
| 413 | G1914 | Morphology: other | Dev and morph | Z-C2H2 | Multiple developmental alterations | 414 | (195-216, 245-266) |
| 415 | G1925 | Morphology: other | Dev and morph | NAC | Multiple developmental alterations | 416 | (6-150) |
| 417 | G1929 | Morphology: other | Dev and morph | Z-CO-like | Slow growth, delayed development | 418 | (31-53) |
| 419 | G1930 | Morphology: other | Dev and morph | AP2 | Multiple developmental alterations | 420 | (59-124) |
| 421 | G195 | Morphology: other | Dev and morph | WRKY | Multiple developmental defects | 422 | (183-239) |
| 423 | G1954 | Morphology: other | Dev and morph | HLH/MYC | Lethal when overexpressed | 424 | (187-259) |
| 425 | G1958 | Morphology: other; seed protein content | Dev and morph; seed biochemistry | GARP | Reduced size and root mass in plates.; altered seed protein content | 426 | (230-278) |
| 427 | G196 | Morphology: other; seed protein content | Dev and morph; seed biochemistry | WRKY | Multiple developmental alterations; altered seed protein content | 428 | (223-283) |
| 429 | G1965 | Morphology: other | Dev and morph | Z-Dof | Lethal when overexpressed | 430 | (27-55) |
| 431 | G1976 | Morphology: other | Dev and morph | Z-C2H2 | Multiple developmental alterations | 432 | (219-323) |
| 433 | G2057 | Morphology: other | Dev and morph | TEO | Multiple developmental alterations | 434 | (TBD) |
| 435 | G2107 | Morphology: other | Dev and morph | AP2 | Multiple developmental alterations | 436 | (TBD) |
| 437 | G211 | Morphology: other | Dev and morph | MYB-(R1)R2R3 | Multiple developmental alterations | 438 | (24-137) |
| 439 | G2133 | Morphology: other; flowering time; seed | Dev and morph; flowering time | AP2 | Multiple developmental alterations; late flowering; altered seed | 440 | (11-83) |

TABLE 5-continued

Genes, traits, transcription factor families and conserved domains

| Poly-nucleotide SEQ ID NO: | GID No. | Trait | Category | Family | Comment | Poly-peptide SEQ ID NO: | Conserved domains |
|---|---|---|---|---|---|---|---|
| | | protein content | | | protein content | | |
| 441 | G2134 | Morphology: other | Dev and morph | AP2 | Multiple developmental alterations | 442 | (TBD) |
| 443 | G2151 | Morphology: other; seed oil and protein content | Dev and morph; seed biochemistry | AT-hook | Multiple developmental alterations; altered seed oil and protein content | 444 | (93-113, 124-144) |
| 445 | G2154 | Morphology: other | Dev and morph | AT-hook | Multiple developmental alterations | 446 | (97-119) |
| 447 | G2157 | Morphology: other | Dev and morph | AT-hook | Multiple developmental alterations | 448 | (82-102, 164-107) |
| 449 | G2181 | Morphology: other | Dev and morph | NAC | Multiple developmental alterations | 450 | (22-169) |
| 451 | G221 | Morphology: other | Dev and morph | MYB-(R1)R2R3 | Multiple developmental alterations | 452 | (21-125) |
| 453 | G2290 | Morphology: other | Dev and morph | WRKY | Multiple developmental alterations | 454 | (147-205) |
| 455 | G2299 | Morphology: other | Dev and morph | AP2 | Multiple developmental alterations | 456 | (48-115) |
| 457 | G2340 | Morphology: other; seed oil and protein content | Dev and morph; seed biochemistry | MYB-(R1)R2R3 | Tissue necrosis; multiple developmental alterations; altered seed oil and protein content | 458 | (14-120) |
| 459 | G2346 | Morphology: other | Dev and morph | SBP | Enlarged seedlings | 460 | (59-135) |
| 461 | G237 | Morphology: other | Dev and morph | MYB-(R1)R2R3 | Multiple developmental alterations | 462 | (11-113) |
| 463 | G2373 | Morphology: other; seed protein content | Dev and morph; seed biochemistry | TH | Multiple developmental alterations; altered seed protein content | 464 | (290-350) |
| 465 | G2376 | Morphology: other; seed oil protein | Dev and morph; seed biochemistry | TH | Seedling lethality; altered seed protein content | 466 | (79-178, 336-408) |
| 467 | G24 | Morphology: other | Dev and morph | AP2 | Reduced size and necrotic patches | 468 | (25-93) |
| 469 | G2424 | Morphology: other | Dev and morph | MYB-(R1)R2R3 | Multiple developmental alterations | 470 | (107-219) |
| 471 | G2505 | Morphology: other | Dev and morph | NAC | Lethal when overexpressed | 472 | (10-159) |
| 473 | G2512 | Morphology: other | Dev and morph | AP2 | Multiple developmental alterations | 474 | (79-139) |
| 475 | G2513 | Morphology: other | Dev and morph | AP2 | Multiple developmental alterations | 476 | (TBD) |
| 477 | G2519 | Morphology: other | Dev and morph | HLH/MYC | Multiple developmental alterations | 478 | (1-65) |
| 479 | G2520 | Morphology: other; seed oil and protein content | Dev and morph; seed biochemistry | HLH/MYC | Multiple developmental alterations; altered seed oil and protein content | 480 | (135-206) |
| 481 | G2533 | Morphology: other; seed protein content | Dev and morph; seed biochemistry | NAC | Multiple developmental alterations; altered seed protein content | 482 | (11-186) |

TABLE 5-continued

Genes, traits, transcription factor families and conserved domains

| Poly-nucleotide SEQ ID NO: | GID No. | Trait | Category | Family | Comment | Poly-peptide SEQ ID NO: | Conserved domains |
|---|---|---|---|---|---|---|---|
| 483 | G2534 | Morphology: other | Dev and morph | NAC | Lethal when overexpressed | 484 | (10-157) |
| 485 | G2573 | Morphology: other; seed oil and protein content | Dev and morph; seed biochemistry | AP2 | Multiple developmental alterations; altered seed oil and protein content | 486 | (31-98) |
| 487 | G2589 | Morphology: other | Dev and morph | MADS | Multiple developmental alterations | 488 | (2-57) |
| 489 | G2687 | Morphology: other | Dev and morph | AP2 | Multiple developmental alterations | 490 | (51-120) |
| 491 | G27 | Morphology: other | Dev and morph | AP2 | Abnormal development, small | 492 | (37-104) |
| 493 | G2720 | Morphology: other; seed oil and protein content | Dev and morph; seed biochemistry | MYB-(R1)R2R3 | Multiple developmental alterations; altered seed oil and protein content | 494 | (10-114) |
| 495 | G2787 | Morphology: other; seed oil content | Dev and morph; seed biochemistry | AT-hook | Multiple developmental alterations; altered seed oil content | 496 | (172-192, 226-247, 256-276, 290-311, 245-366) |
| 497 | G2789 | Morphology: other | Dev and morph | AT-hook | Multiple developmental alterations | 498 | (53-73, 121-165) |
| 499 | G31 | Morphology: other | Dev and morph | AP2 | Multiple developmental alterations | 500 | (TBD) |
| 501 | G33 | Morphology: other | Dev and morph | AP2 | Multiple developmental defects | 502 | (50-117) |
| 503 | G342 | Morphology: other; seed oil and protein content | Dev and morph; seed biochemistry | GATA/Zn | Multiple developmental alterations; altered seed oil and protein content | 504 | (155-190) |
| 505 | G352 | Morphology: other | Dev and morph | Z-C2H2 | Multiple developmental alterations | 506 | (99-119, 166-186) |
| 507 | G357 | Morphology: other | Dev and morph | Z-C2H2 | Developmental defect | 508 | (7-29) |
| 509 | G358 | Morphology: other | Dev and morph | Z-C2H2 | Lethal when overexpressed | 510 | (124-135, 188-210) |
| 511 | G360 | Morphology: other | Dev and morph | Z-C2H2 | Multiple developmental alterations | 512 | (42-62) |
| 513 | G362 | Size; Morphology: other; trichome; flowering time; seed protein content | Dev and morph; flowering time; seed biochemistry | Z-C2H2 | Reduced size; increased pigmentation in seed, embryos and other organs; ectopic trichome formation; increased trichome number; late flowering; altered protein content | 514 | (62-82) |
| 515 | G364 | Morphology: other | Dev and morph | Z-C2H2 | Developmental defect | 516 | (54-76) |
| 517 | G365 | Morphology: other | Dev and morph | Z-C2H2 | Multiple developmental alterations | 518 | (70-90) |
| 519 | G367 | Morphology: other | Dev and morph | Z-C2H2 | Lethal when overexpressed | 520 | (63-84) |
| 521 | G373 | Morphology: other | Dev and morph | RING/C3HC4 | Multiple developmental alterations | 522 | (129-168) |
| 523 | G396 | Morphology: other; size | Dev and morph | HB | Altered leaf coloration and shape, reduced fertility; small plant | 524 | (159-220) |

TABLE 5-continued

Genes, traits, transcription factor families and conserved domains

| Poly-nucleotide SEQ ID NO: | GID No. | Trait | Category | Family | Comment | Polypeptide SEQ ID NO: | Conserved domains |
|---|---|---|---|---|---|---|---|
| 525 | G431 | Morphology: other | Dev and morph | HB | Developmental defect, sterile | 526 | (286-335) |
| 527 | G479 | Morphology: other | Dev and morph | SBP | Multiple developmental alterations | 528 | (70-149) |
| 529 | G546 | Morphology: other | Dev and morph | RING/C3H2C3 | Slow growth and development; increased anthocyanin pigmentation | 530 | (114-155) |
| 531 | G551 | Morphology: other | Dev and morph | HB | Multiple developmental alterations | 532 | (73-133) |
| 533 | G578 | Morphology: other | Dev and morph | bZIP | Lethal when overexpressed | 534 | (36-96) |
| 535 | G596 | Morphology: other | Dev and morph | AT-hook | Multiple developmental alterations | 536 | (89-96) |
| 537 | G617 | Morphology: other | Dev and morph | TEO | Multiple developmental alterations | 538 | (64-118) |
| 539 | G620 | Morphology: other; seed protein content | Dev and morph; seed biochemistry | CAAT | Multiple developmental alterations; altered seed protein content | 540 | (20-118) |
| 541 | G625 | Morphology: other | Dev and morph | AP2 | Lethal when overexpressed | 542 | (52-119) |
| 543 | G658 | Morphology: other | Dev and morph | MYB-(R1)R2R3 | Developmental defect | 544 | (2-105) |
| 545 | G716 | Morphology: other | Dev and morph | ARF | Multiple developmental defects | 546 | (24-355) |
| 547 | G725 | Morphology: other | Dev and morph | GARP | Developmental defect | 548 | (39-87) |
| 549 | G727 | Morphology: other | Dev and morph | GARP | Multiple morphological alterations | 550 | (226-269) |
| 551 | G740 | Morphology: other | Dev and morph | Z-CLDSH | Slow growth | 552 | (24-42, 232-268) |
| 553 | G770 | Morphology: other | Dev and morph | NAC | Multiple developmental alterations | 554 | (19-162) |
| 555 | G858 | Morphology: other | Dev and morph | MADS | Multiple developmental alterations | 556 | (2-57) |
| 557 | G865 | Morphology: other; seed protein content | Dev and morph; seed biochemistry | AP2 | Altered morphology; increased seed protein | 558 | (36-103) |
| 559 | G872 | Morphology: other | Dev and morph | AP2 | Multiple developmental alterations | 560 | (18-85) |
| 561 | G904 | Morphology: other | Dev and morph | RING/C3H2C3 | Multiple developmental alterations | 562 | (117-158) |
| 563 | G910 | Morphology: other; flowering time | Dev and morph; flowering time | Z-CO-like | Multiple developmental alterations; late flowering | 564 | (14-37, 77-103) |
| 565 | G912 | Morphology: other; size; sugar sensing; flowering time | Dev and morph; sugar sensing; flowering time | AP2 | Dark green color; small plant; reduced cotyledon expansion in glucose; late flowering | 566 | (51-118) |
| 567 | G920 | Morphology: other | Dev and morph | WRKY | Multiple developmental alterations | 568 | (152-211) |
| 569 | G939 | Morphology: other; size | Dev and morph | EIL | Pale seedlings on agar; reduced size | 570 | (97-106) |
| 571 | G963 | Morphology: other; seed protein content | Dev and morph; seed biochemistry | NAC | Slowed growth rate; altered seed protein content | 572 | (TBD) |

TABLE 5-continued

Genes, traits, transcription factor families and conserved domains

| Poly-nucleotide SEQ ID NO: | GID No. | Trait | Category | Family | Comment | Poly-peptide SEQ ID NO: | Conserved domains |
|---|---|---|---|---|---|---|---|
| 573 | G979 | Morphology: other; seed | Dev and morph | AP2 | Several developmental defects; altered seed development, ripening and germination | 574 | (63-139, 165-233) |
| 575 | G987 | Morphology: other | Dev and morph | SCR | Developmental defects | 576 | (428-432, 704-708) |
| 577 | G993 | Morphology: other; seed protein content | Dev and morph; seed biochemistry | AP2 | Multiple developmental alterations; altered seed protein content | 578 | (69-134) |
| 579 | G681 | Morphology: other; leaf glucosinolates | Dev and morph; leaf biochemistry | MYB-(R1)R2R3 | Multiple developmental alterations; overexpression results in an increase in M39480 | 580 | (14-120) |
| 581 | G1482 | Root | Dev and morph | Z-CO-like | Increased root growth | 582 | (5-63) |
| 583 | G225 | Root; trichome | Dev and morph | MYB-related | Increased root hairs; glabrous, lack of trichomes | 584 | (39-76) |
| 585 | G226 | Root; trichome; seed protein content | Dev and morph; seed biochemistry | MYB-related | Increased root hairs; glabrous, lack of trichomes; increased seed protein | 586 | (28-78) |
| 587 | G9 | Root | Dev and morph | AP2 | Increased root mass | 588 | (62-127) |
| 589 | G1040 | Seed | Dev and morph | GARP | Smaller and more rounded seeds | 590 | (109-158) |
| 591 | G2114 | Seed | Dev and morph | AP2 | Increased seed size | 592 | (221-297, 323-393) |
| 593 | G450 | Seed; size; seed protein content | Dev and morph; seed biochemistry | IAA | Increased seed size; reduced plant size; altered seed protein content | 594 | (TBD) |
| 595 | G584 | Seed | Dev and morph | HLH/MYC | Large seeds | 596 | (401-494) |
| 597 | G668 | Seed | Dev and morph | MYB-(R1)R2R3 | Reduced seed color | 598 | (13-113) |
| 599 | G1050 | Senescence | Dev and morph | bZIP | Delayed senescence | 600 | (372-425) |
| 601 | G1463 | Senescence | Dev and morph | NAC | Premature senescence | 602 | (9-156) |
| 603 | G1944 | Senescence; size; seed protein content | Dev and morph; seed biochemistry | AT-hook | Early senescence; reduced size; altered seed protein content | 604 | (87-100) |
| 605 | G2383 | Senescence; seed protein content | Dev and morph; seed biochemistry | TEO | Early senescence; altered seed protein content | 606 | (89-149) |
| 607 | G571 | Senescence; flowering time | Dev and morph; flowering time | bZIP | Delayed senescence; late flowering | 608 | (160-220) |
| 609 | G636 | Senescence; size | Dev and morph | TH | Premature senescence; reduced size | 610 | (55-145, 405-498) |
| 611 | G878 | Senescence; flowering time | Dev and morph; flowering time | WRKY | Delayed senescence; late flowering | 612 | (250-305, 415-475) |
| 613 | G1134 | Silique | Dev and morph | HLH/MYC | Siliques with altered shape | 614 | (198-247) |
| 615 | G1008 | Size | Dev and morph | AP2 | Small plant | 616 | (96-163) |
| 617 | G1020 | Size | Dev and morph | AP2 | Very small T1 plants | 618 | (28-95) |
| 619 | G1023 | Size | Dev and morph | AP2 | Reduced size | 620 | (128-195) |
| 621 | G1053 | Size | Dev and morph | bZIP | Small plant | 622 | (74-120) |
| 623 | G1137 | Size | Dev and morph | HLH/MYC | Small T1 plants | 624 | (264-314) |

TABLE 5-continued

Genes, traits, transcription factor families and conserved domains

| Polynucleotide SEQ ID NO: | GID No. | Trait | Category | Family | Comment | Polypeptide SEQ ID NO: | Conserved domains |
|---|---|---|---|---|---|---|---|
| 625 | G1181 | Size | Dev and morph | HS | Small T1 plants | 626 | (24-114) |
| 627 | G1228 | Size | Dev and morph | HLH/MYC | Reduced size | 628 | (179-233) |
| 629 | G1277 | Size | Dev and morph | AP2 | Small plant | 630 | (18-85) |
| 631 | G1309 | Size | Dev and morph | MYB-(R1)R2R3 | Small plant | 632 | (9-114) |
| 633 | G1314 | Size; sugar sensing; seed protein content | Dev and morph; sugar sensing; seed biochemistry | MYB-(R1)R2R3 | Reduced size; reduced seedling vigor on high glucose; altered seed protein content | 634 | (14-116) |
| 635 | G1317 | Size | Dev and morph | MYB-(R1)R2R3 | Reduced size | 636 | (13-118) |
| 637 | G1323 | Size; seed oil and protein content | Dev and morph; seed biochemistry | MYB-(R1)R2R3 | Small T1 plants, dark green; decreased seed oil, increased seed protein | 638 | (15-116) |
| 639 | G1332 | Size; trichome; seed oil and protein content | Dev and morph; seed biochemistry | MYB-(R1)R2R3 | Reduced size; reduced trichome density; altered seed oil and protein content | 640 | (13-116) |
| 641 | G1334 | Size | Dev and morph | CAAT | Small, dark green | 642 | (18-190) |
| 643 | G1381 | Size | Dev and morph | AP2 | Reduced size | 644 | (68-135) |
| 645 | G1382 | Size | Dev and morph | WRKY | Small plant | 646 | (210-266, 385-437) |
| 647 | G1435 | Size; flowering time | Dev and morph; flowering time | GARP | Increased plant size; late flowering | 648 | (146-194) |
| 649 | G1537 | Size | Dev and morph | HB | Small T1 plants with altered development | 650 | (14-74) |
| 651 | G1545 | Size | Dev and morph | HB | Reduced size | 652 | (54-117) |
| 653 | G1641 | Size; seed oil and protein content | Dev and morph; seed biochemistry | MYB-related | Small plant; altered seed oil and protein content | 654 | (139-200) |
| 655 | G165 | Size; seed protein content | Dev and morph; seed biochemistry | MADS | Reduced size; altered seed protein content | 656 | (7-62) |
| 657 | G1652 | Size; seed oil and protein content | Dev and morph; seed biochemistry | HLH/MYC | Reduced size; altered seed oil and protein content | 658 | (143-215) |
| 659 | G1655 | Size | Dev and morph | HLH/MYC | Small plant | 660 | (134-192) |
| 661 | G1671 | Size | Dev and morph | NAC | Reduced size | 662 | (TBD) |
| 663 | G1756 | Size; seed protein content | Dev and morph; seed biochemistry | WRKY | Reduced size; altered seed protein content | 664 | (TBD) |
| 665 | G1757 | Size; seed protein content | Dev and morph; seed biochemistry | WRKY | Small plant; altered seed protein content | 666 | (158-218) |
| 667 | G1782 | Size | Dev and morph | CAAT | Small, spindly plant | 668 | (166-238) |
| 669 | G184 | Size | Dev and morph | WRKY | Small plant | 670 | (295-352) |
| 671 | G1845 | Size | Dev and morph | AP2 | Small plant | 672 | (140-207) |
| 673 | G1879 | Size; seed oil and protein content | Dev and morph; seed biochemistry | HLH/MYC | Reduced size; altered seed oil and protein content | 674 | (107-176) |
| 675 | G1888 | Size | Dev and morph | Z-CO-like | Reduced size, dark green leaves | 676 | (5-50) |
| 677 | G189 | Size; seed protein content | Dev and morph; seed biochemistry | WRKY | Increased leaf size; altered seed protein content | 678 | (240-297) |
| 679 | G1939 | Size | Dev and morph | PCF | Reduced size | 680 | (40-102) |

TABLE 5-continued

Genes, traits, transcription factor families and conserved domains

| Polynucleotide SEQ ID NO: | GID No. | Trait | Category | Family | Comment | Polypeptide SEQ ID NO: | Conserved domains |
|---|---|---|---|---|---|---|---|
| 681 | G194 | Size | Dev and morph | WRKY | Small plant | 682 | (174-230) |
| 683 | G1943 | Size | Dev and morph | HLH/MYC | Reduced size | 684 | (335-406) |
| 685 | G21 | Size; seed oil and protein content | Dev and morph; seed biochemistry | AP2 | Reduced size; altered seed oil and protein content | 686 | (97-164) |
| 687 | G2132 | Size; seed oil and protein content | Dev and morph; seed biochemistry | AP2 | Reduced size; altered seed oil and protein content | 688 | (TBD) |
| 689 | G2145 | Size | Dev and morph | HLH/MYC | Reduced size | 690 | (166-243) |
| 691 | G23 | Size | Dev and morph | AP2 | Small T1 plants | 692 | (61-117) |
| 693 | G2313 | Size | Dev and morph | MYB-related | Reduced size | 694 | (TBD) |
| 695 | G2344 | Size | Dev and morph | CAAT | Reduced size, slow growth | 696 | (TBD) |
| 697 | G2430 | Size | Dev and morph | GARP | Increased leaf size, faster development | 698 | (425-478) |
| 699 | G2517 | Size | Dev and morph | WRKY | Reduced size | 700 | (118-234) |
| 701 | G2521 | Size | Dev and morph | HLH/MYC | Reduced size | 702 | (145-213) |
| 703 | G258 | Size; seed oil and protein content | Dev and morph; seed biochemistry | MYB-(R1)R2R3 | Reduced size; altered seed oil and protein content | 704 | (24-124) |
| 705 | G280 | Size; seed protein content | Dev and morph; seed biochemistry | AT-hook | Reduced size; altered seed protein content | 706 | (97-104, 130-137-155-162, 185-192) |
| 707 | G3 | Size | Dev and morph | AP2 | Small plant | 708 | (28-95) |
| 709 | G343 | Size | Dev and morph | GATA/Zn | Small plant | 710 | (178-214) |
| 711 | G363 | Size | Dev and morph | Z-C2H2 | Small plant | 712 | (87-108) |
| 713 | G370 | Size | Dev and morph | Z-C2H2 | Reduced size, shiny leaves | 714 | (97-117) |
| 715 | G385 | Size | Dev and morph | HB | Small plant, short inflorescence stems, dark green | 716 | (60-123) |
| 717 | G439 | Size | Dev and morph | AP2 | Small plant | 718 | (110-177) |
| 719 | G440 | Size | Dev and morph | AP2 | Small plant | 720 | (122-189) |
| 721 | G5 | Size | Dev and morph | AP2 | Small plant | 722 | (149-216) |
| 723 | G550 | Size | Dev and morph | Z-Dof | Small plant | 724 | (134-180) |
| 725 | G670 | Size | Dev and morph | MYB-(R1)R2R3 | Small plant | 726 | (14-122) |
| 727 | G760 | Size | Dev and morph | NAC | Reduced size | 728 | (12-156) |
| 729 | G831 | Size | Dev and morph | AKR | Reduced size | 730 | (470-591) |
| 731 | G864 | Size | Dev and morph | AP2 | Small plant | 732 | (119-186) |
| 733 | G884 | Size | Dev and morph | WRKY | Reduced size | 734 | (227-285, 407-465) |
| 735 | G898 | Size; seed oil and protein content | Dev and morph; seed biochemistry | RING/C3HC4 | Reduced size; altered seed oil and protein content | 736 | (148-185) |
| 737 | G900 | Size | Dev and morph | Z-CO-like | Reduced size | 738 | (6-28, 48-74) |
| 739 | G913 | Size; flowering time | Dev and morph; flowering time | AP2 | Small plant; late flowering | 740 | (62-128) |
| 741 | G937 | Size | Dev and morph | GARP | Slightly reduced size | 742 | (197-246) |
| 743 | G960 | Size | Dev and morph | NAC | Small plant | 744 | (13-156) |

TABLE 5-continued

Genes, traits, transcription factor families and conserved domains

| Poly-nucleotide SEQ ID NO: | GID No. | Trait | Category | Family | Comment | Poly-peptide SEQ ID NO: | Conserved domains |
|---|---|---|---|---|---|---|---|
| 745 | G991 | Size; seed oil and protein content | Dev and morph; seed biochemistry | IAA | Slightly reduced size; altered seed oil and protein content | 746 | (7-14, 48-59, 82-115, 128-164) |
| 747 | G748 | Stem; flowering time | Dev and morph; flowering time | Z-Dof | More vascular bundles in stem; late flowering | 748 | (112-140) |
| 749 | G247 | Trichome; seed protein content | Dev and morph; seed biochemistry | MYB-(R1)R2R3 | Altered trichome distribution; altered seed protein content | 750 | (15-116) |
| 751 | G585 | Trichome | Dev and morph | HLH/MYC | Reduced trichome density | 752 | (436-501) |
| 753 | G634 | Trichome; seed protein content | Dev and morph; seed biochemistry | TH | Increased trichome density and size; altered seed protein content | 754 | (62-147, 189-245) |
| 755 | G676 | Trichome | Dev and morph | MYB-(R1)R2R3 | Reduced trichomes | 756 | (17-119) |
| 757 | G682 | Trichome | Dev and morph | MYB-related | Glabrous, lack of trichomes | 758 | (27-63) |
| 759 | G635 | Variegation | Dev and morph | TH | | 760 | (239-323) |
| 761 | G1068 | Sugar sensing | Sugar sensing | AT-hook | Reduced cotyledon expansion in glucose | 762 | (143-150) |
| 763 | G1225 | Sugar sensing; seed oil and protein content | Sugar sensing; seed biochemistry | HLH/MYC | Better germination on sucrose and glucose media; altered seed oil and protein content | 764 | (78-147) |
| 765 | G1337 | Sugar sensing | Sugar sensing | Z-CO-like | Decreased germination on sucrose medium | 766 | (9-75) |
| 767 | G1759 | Sugar sensing | Sugar sensing | MADS | Reduced germination on high glucose | 768 | (2-57) |
| 769 | G1804 | Sugar sensing; flowering time | Sugar sensing; flowering time | bZIP | Altered sugar sensing; late flowering | 770 | (357-407) |
| 771 | G207 | Sugar sensing | Sugar sensing | MYB-(R1)R2R3 | Decreased germination on glucose medium | 772 | (6-106) |
| 773 | G218 | Sugar sensing; seed oil content | Sugar sensing; seed biochemistry | MYB-(R1)R2R3 | Reduced cotyledon expansion in glucose; altered seed oil content | 774 | (TBD) |
| 775 | G241 | Sugar sensing; seed oil and protein content | Sugar sensing; seed biochemistry | MYB-(R1)R2R3 | Decreased germination and growth on glucose medium; decreased seed oil, altered protein content | 776 | (14-114) |
| 777 | G254 | Sugar sensing | Sugar sensing | MYB-related | Decreased germination and growth on glucose medium | 778 | (62-106) |
| 779 | G26 | Sugar sensing | Sugar sensing | AP2 | Decreased germination and growth on glucose medium | 780 | (67-134) |
| 781 | G263 | Sugar sensing | Sugar sensing | HS | Decreased root growth on sucrose medium, root specific expression | 782 | (TBD) |
| 783 | G308 | Sugar sensing | Sugar sensing | SCR | No germination on glucose medium | 784 | (270-274) |
| 785 | G38 | Sugar sensing | Sugar sensing | AP2 | Reduced germination on glucose medium | 786 | (76-143) |
| 787 | G43 | Sugar sensing | Sugar sensing | AP2 | Decreased germination and growth on glucose medium | 788 | (104-172) |
| 789 | G536 | Sugar sensing | Sugar sensing | GF14 | Decreased germination and growth on glucose medium | 790 | (226-233) |
| 791 | G567 | Sugar sensing; seed oil and protein content | Sugar sensing; seed biochemistry | bZIP | Decreased seedling vigor on high glucose; altered seed oil and protein content | 792 | (210-270) |

TABLE 5-continued

Genes, traits, transcription factor families and conserved domains

| Polynucleotide SEQ ID NO: | GID No. | Trait | Category | Family | Comment | Polypeptide SEQ ID NO: | Conserved domains |
|---|---|---|---|---|---|---|---|
| 793 | G680 | Sugar sensing; flowering time | Sugar sensing; flowering time | MYB-related | Reduced germination on glucose medium; late flowering | 794 | (24-70) |
| 795 | G867 | Sugar sensing | Sugar sensing | AP2 | Better seedling vigor on sucrose medium | 796 | (59-124) |
| 797 | G956 | Sugar sensing | Sugar sensing | NAC | Reduced germination on glucose medium | 798 | (TBD) |
| 799 | G996 | Sugar sensing | Sugar sensing | MYB-(R1)R2R3 | Reduced germination on glucose medium | 800 | (14-114) |
| 801 | G1946 | Seed glucosinolates, oil, protein content | Seed biochemistry | HS | Increase in M3950; increased oil content; decreased protein content | 802 | (32-130) |
| 803 | G217 | Seed oil composition | Seed biochemistry | MYB-related | Increase in 20:2 | 804 | (8-67) |
| 805 | G2192 | Seed oil composition | Seed biochemistry | bZIP-NIN | Altered composition | 806 | (600-700) |
| 807 | G504 | Seed oil composition; seed protein content | Seed biochemistry | NAC | Altered seed oil composition and content; altered seed protein content | 808 | (TBD) |
| 809 | G622 | Seed oil composition | Seed biochemistry | ABI3/VP-1 | Decreased 18:2 fatty acid | 810 | (TBD) |
| 811 | G778 | Seed oil composition | Seed biochemistry | HLH/MYC | Increased seed 18:1 fatty acid | 812 | (220-267) |
| 813 | G791 | Seed oil composition | Seed biochemistry | HLH/MYC | Altered seed fatty acid composition | 814 | (75-143) |
| 815 | G861 | Seed oil composition; seed oil content | Seed biochemistry | MADS | Increase in 16:1; altered seed oil content | 816 | (2-57) |
| 817 | G938 | Seed oil composition | Seed biochemistry | EIL | Altered seed fatty acid composition | 818 | (96-104) |
| 819 | G965 | Seed oil composition | Seed biochemistry | HB | Increase in 18:1 | 820 | (423-486) |
| 821 | G1143 | Seed oil and protein content | Seed biochemistry | HLH/MYC | Altered seed oil and protein content | 822 | (33-82) |
| 823 | G1190 | Seed oil content | Seed biochemistry | AKR | Increased content | 824 | (entire protein) |
| 825 | G1198 | Seed oil and protein content | Seed biochemistry | bZIP | Altered seed oil and protein content | 826 | (173-223) |
| 827 | G1226 | Seed oil and protein content | Seed biochemistry | HLH/MYC | Altered seed oil and protein content | 828 | (115-174) |
| 829 | G1451 | Seed oil content | Seed biochemistry | ARF | Altered seed oil content | 830 | (22-357) |
| 831 | G1478 | Seed oil and protein content; flowering time | Seed biochemistry; flowering time | Z-CO-like | Altered seed oil, protein content; late flowering | 832 | (32-76) |
| 833 | G1496 | Seed oil content | Seed biochemistry | HLH/MYC | Altered seed oil content | 834 | (184-248) |
| 835 | G1526 | Seed oil content | Seed biochemistry | SWI/SNF | Increased seed oil content | 836 | (493-620, 864-1006) |
| 837 | G1543 | Seed oil content | Seed biochemistry | HB | Decreased seed oil | 838 | (135-195) |
| 839 | G162 | Seed oil and protein content | Seed biochemistry | MADS | Altered seed oil content; altered seed oil and protein content | 840 | (2-57) |
| 841 | G1640 | Seed oil content | Seed biochemistry | MYB-(R1)R2R3 | Increased seed oil | 842 | (14-115) |
| 843 | G1644 | Seed oil and protein content | Seed biochemistry | MYB-(R1)R2R3 | Altered seed oil, protein content | 844 | (39-102) |
| 845 | G1646 | Seed oil content | Seed biochemistry | CAAT | Altered seed oil content | 846 | (72-162) |
| 847 | G1672 | Seed oil content | Seed biochemistry | NAC | Altered seed oil content | 848 | (41-194) |

TABLE 5-continued

Genes, traits, transcription factor families and conserved domains

| Polynucleotide SEQ ID NO: | GID No. | Trait | Category | Family | Comment | Polypeptide SEQ ID NO: | Conserved domains |
|---|---|---|---|---|---|---|---|
| 849 | G1677 | Seed oil and protein content | Seed biochemistry | NAC | Altered seed oil, protein content | 850 | (17-181) |
| 851 | G1765 | Seed oil and protein content | Seed biochemistry | NAC | Altered seed oil and protein content | 852 | (20-140) |
| 853 | G1777 | Seed oil and protein content | Seed biochemistry | RING/C3HC4 | Increased oil, decreased protein content | 854 | (124-247) |
| 855 | G1793 | Seed oil content | Seed biochemistry | AP2 | Increased seed oil content | 856 | (179-255, 281-349) |
| 857 | G180 | Seed oil content | Seed biochemistry | WRKY | Decreased seed oil content | 858 | (118-174) |
| 859 | G192 | Seed oil and protein content; flowering time | Seed biochemistry; flowering time | WRKY | Altered seed oil and protein content; late flowering | 860 | (128-185) |
| 861 | G1948 | Seed oil and protein content | Seed biochemistry | AKR | Altered seed oil and protein content | 862 | (entire protein) |
| 863 | G2123 | Seed oil and protein content | Seed biochemistry | GF14 | Altered seed oil and protein content | 864 | (99-109) |
| 865 | G2138 | Seed oil content | Seed biochemistry | AP2 | Increased seed oil content | 866 | (TBD) |
| 867 | G2139 | Seed oil content | Seed biochemistry | MADS | Increased seed content | 868 | (14-69) |
| 869 | G2343 | Seed oil content | Seed biochemistry | MYB-(R1)R2R3 | Altered seed oil content | 870 | (14-116) |
| 871 | G265 | Seed oil and protein content | Seed biochemistry | HS | Altered seed oil and protein content | 872 | (11-105) |
| 873 | G2792 | Seed oil content | Seed biochemistry | HLH/MYC | Increased seed oil content | 874 | (190-258) |
| 875 | G2830 | Seed oil and protein content | Seed biochemistry | Z-C2H2 | Altered seed oil and protein content | 876 | (245-266) |
| 877 | G286 | Seed oil and protein content | Seed biochemistry | ENBP | Altered seed oil and protein content | 878 | (TBD) |
| 879 | G291 | Seed oil content | Seed biochemistry | MISC | Increased seed oil content | 880 | (132-160) |
| 881 | G427 | Seed oil and protein content | Seed biochemistry | HB | Increased oil content; decreased protein content | 882 | (307-370) |
| 883 | G509 | Seed oil and protein content | Seed biochemistry | NAC | Altered seed oil and protein content | 884 | (13-169) |
| 885 | G519 | Seed oil and protein content | Seed biochemistry | NAC | Altered seed oil and protein content | 886 | (11-104) |
| 887 | G561 | Seed oil content | Seed biochemistry | bZIP | Altered seed oil content | 888 | (248-308) |
| 889 | G590 | Seed oil and protein content | Seed biochemistry | HLH/MYC | Altered seed oil and protein content | 890 | (202-254) |
| 891 | G818 | Seed oil content | Seed biochemistry | HS | Increased content | 892 | (70-162) |
| 893 | G849 | Seed oil and protein content | Seed biochemistry | BPF-1 | Increased seed oil, altered protein content | 894 | (324-413, 504-583) |
| 895 | G892 | Seed oil and protein content | Seed biochemistry | RING/C3H2C3 | Altered seed oil, protein content | 896 | (177-270) |
| 897 | G961 | Seed oil content | Seed biochemistry | NAC | Altered seed oil content | 898 | (15-140) |
| 899 | G1465 | Seed oil and protein content | Seed biochemistry | NAC | Altered seed oil and protein content | 900 | (242-306) |
| 901 | G425 | Seed oil content | Seed biochemistry | HB | Altered seed oil content | 902 | (TBD) |

TABLE 5-continued

Genes, traits, transcription factor families and conserved domains

| Polynucleotide SEQ ID NO: | GID No. | Trait | Category | Family | Comment | Polypeptide SEQ ID NO: | Conserved domains |
|---|---|---|---|---|---|---|---|
| 903 | G347 | Seed oil and protein content | Seed biochemistry | Z-LSDlike | Altered seed oil and protein content | 904 | (9-39, 50-70, 80-127) |
| 905 | G1512 | Seed oil and protein content | Seed biochemistry | RING/C3HC4 | Altered seed oil and protein content | 906 | (39-93) |
| 907 | G2069 | Seed oil and protein content | Seed biochemistry | bZIP | Altered seed oil and protein content | 908 | (TBD) |
| 909 | G1852 | Seed oil content | Seed biochemistry | AKR | Altered seed oil content | 910 | (1-601) |
| 911 | G1793 | Seed oil content | Seed biochemistry | AP2 | Altered seed oil content | 912 | (179-255, 281-349) |
| 913 | G761 | Seed oil and protein content | Seed biochemistry | NAC | Altered seed oil and protein content | 914 | (10-156) |
| 915 | G1056 | Seed oil content | Seed biochemistry | bZIP | Altered seed oil content | 916 | (183-246) |
| 917 | G1447 | Seed oil content | Seed biochemistry | MISC | Altered seed oil content | 918 | (3-54, 124-156) |
| 919 | G323 | Seed oil and protein content | Seed biochemistry | RING/C3HC4 | Altered seed oil and protein content | 920 | (48-96) |
| 921 | G176 | Seed oil content | Seed biochemistry | WRKY | Altered seed oil content | 922 | (117-173, 234-290) |
| 923 | G174 | Seed oil and protein content | Seed biochemistry | WRKY | Altered seed oil and protein content | 924 | (111-166, 283-339) |
| 925 | G715 | Seed oil content | Seed biochemistry | CAAT | Altered seed oil content | 926 | (60-132) |
| 927 | G588 | Seed oil and protein content | Seed biochemistry | HLH/MYC | Altered seed oil and protein content | 928 | (309-376) |
| 929 | G1758 | Seed oil and protein content | Seed biochemistry | WRKY | Altered seed oil and protein content | 930 | (109-165) |
| 931 | G2148 | Seed oil content | Seed biochemistry | HLH/MYC | Altered seed oil content | 932 | (130-268) |
| 933 | G2379 | Seed oil content | Seed biochemistry | TH | Altered seed oil content | 934 | (19-110, 173-232) |
| 935 | G1462 | Seed oil content | Seed biochemistry | NAC | Altered seed oil content | 936 | (TBD) |
| 937 | G1211 | Seed oil and protein content | Seed biochemistry | MISC | Altered seed oil and protein content | 938 | (123-179) |
| 939 | G1048 | Seed oil content | Seed biochemistry | bZIP | Altered seed oil content | 940 | (138-190) |
| 941 | G986 | Seed oil content | Seed biochemistry | WRKY | Altered seed oil content | 942 | (146-203) |
| 943 | G789 | Seed oil content | Seed biochemistry | HLH/MYC | Altered seed oil content | 944 | (253-313) |
| 945 | G2085 | Seed oil and protein content | Seed biochemistry | RING/C3HC4 | Altered seed oil and protein content | 946 | (TBD) |
| 947 | G1783 | Seed oil and protein content | Seed biochemistry | MYB-related | Altered seed oil and protein content | 948 | (81 . . . 129) |
| 949 | G2072 | Seed oil and protein content | Seed biochemistry | bZIP | Altered seed oil and protein content | 950 | (90-149) |
| 951 | G931 | Seed oil and protein content | Seed biochemistry | CAAT | Altered seed oil and protein content | 952 | (TBD) |
| 953 | G278 | Seed oil and protein content | Seed biochemistry | AKR | Altered seed oil and protein content | 954 | (2-593) |
| 955 | G2421 | Seed oil content | Seed biochemistry | MYB-(R1)R2R3 | Altered seed oil content | 956 | (9-110) |
| 957 | G2032 | Seed oil content | Seed biochemistry | AKR | Altered seed oil content | 958 | (entire protein) |

TABLE 5-continued

Genes, traits, transcription factor families and conserved domains

| Poly-nucleotide SEQ ID NO: | GID No. | Trait | Category | Family | Comment | Poly-peptide SEQ ID NO: | Conserved domains |
|---|---|---|---|---|---|---|---|
| 959 | G1396 | Seed oil and protein content | Seed biochemistry | S1FA | Altered seed oil and protein content | 960 | (TBD) |
| 961 | G619 | Seed oil and protein content | Seed biochemistry | ARF | Altered seed oil and protein content | 962 | (64-406) |
| 963 | G2295 | Seed oil content | Seed biochemistry | MADS | Altered seed oil content | 964 | (2-57) |
| 965 | G312 | Seed oil content | Seed biochemistry | SCR | Altered seed oil content | 966 | (320-336) |
| 967 | G1444 | Seed oil and protein content | Seed biochemistry | GRF-like | Altered seed oil and protein content | 968 | (168-193) |
| 969 | G801 | Seed oil content | Seed biochemistry | PCF | Altered seed oil content | 970 | (32-93) |
| 971 | G1950 | Seed oil content | Seed biochemistry | AKR | Altered seed oil content | 972 | (65-228) |
| 973 | G958 | Seed oil and protein content | Seed biochemistry | NAC | Altered seed oil and protein content | 974 | (7-156) |
| 975 | G1037 | Seed oil and protein content | Seed biochemistry | GARP | Altered seed oil and protein content | 976 | (11-134, 200-248) |
| 977 | G2065 | Seed oil content | Seed biochemistry | MADS | Altered seed oil content | 978 | (TBD) |
| 979 | G2137 | Seed oil and protein content | Seed biochemistry | WRKY | Altered seed oil and protein content | 980 | (109-168) |
| 981 | G746 | Seed oil content | Seed biochemistry | RING/C3HC4 | Altered seed oil content | 982 | (139-178) |
| 983 | G2701 | Seed oil and protein content | Seed biochemistry | MYB-related | Altered seed oil and protein content | 984 | (33-81, 129-183) |
| 985 | G1819 | Seed oil content | Seed biochemistry | CAAT | Altered seed oil content | 986 | (46-188) |
| 987 | G1227 | Seed oil and protein content | Seed biochemistry | HLH/MYC | Altered seed oil and protein content | 988 | (183-244) |
| 989 | G2417 | Seed oil content | Seed biochemistry | GARP | Altered seed oil content | 990 | (235-285) |
| 991 | G2116 | Seed oil content | Seed biochemistry | bZIP | Altered seed oil content | 992 | (150-210) |
| 993 | G647 | Seed oil content | Seed biochemistry | Z-C3H | Altered seed oil content | 994 | (77-192) |
| 995 | G974 | Seed oil and protein content | Seed biochemistry | AP2 | Altered seed oil and protein content | 996 | (81-140) |
| 997 | G1419 | Seed protein content | Seed biochemistry | AP2 | Increased seed protein | 998 | (69-137) |
| 999 | G1634 | Seed protein content | Seed biochemistry | MYB-related | Altered seed protein content | 1000 | (129-180) |
| 1001 | G1637 | Seed protein content | Seed biochemistry | MYB-related | Altered seed protein content | 1002 | (109-173) |
| 1003 | G1818 | Seed protein content; flowering time | Seed biochemistry; flowering time | CAAT | Increased protein content; late flowering | 1004 | (36-113) |
| 1005 | G1820 | Seed oil and protein content | Seed biochemistry | CAAT | Altered seed oil, protein content | 1006 | (70-133) |
| 1007 | G1903 | Seed oil and protein content | Seed biochemistry | Z-Dof | Altered seed oil and protein content | 1008 | (134-180) |
| 1009 | G371 | Seed oil and protein content | Seed biochemistry | RING/C3HC4 | Altered seed oil and protein content | 1010 | (21-74) |
| 1011 | G597 | Seed protein content | Seed biochemistry | AT-hook | Altered seed protein content | 1012 | (97-104, 137-144) |
| 1013 | G1009 | Seed protein content | Seed biochemistry | AP2 | Altered seed protein content | 1014 | (201-277, 303-371) |
| 1015 | G170 | Seed protein content | Seed biochemistry | MADS | Altered seed protein content | 1016 | (2-57) |

TABLE 5-continued

Genes, traits, transcription factor families and conserved domains

| Poly-nucleotide SEQ ID NO: | GID No. | Trait | Category | Family | Comment | Poly-peptide SEQ ID NO: | Conserved domains |
|---|---|---|---|---|---|---|---|
| 1017 | G1768 | Seed protein content | Seed biochemistry | SCR | Altered seed protein content | 1018 | (54-413) |
| 1019 | G185 | Seed protein content | Seed biochemistry | WRKY | Altered seed protein content | 1020 | (113-172) |
| 1021 | G1931 | Seed protein content | Seed biochemistry | WRKY | Altered seed protein content | 1022 | (114-170) |
| 1023 | G2543 | Seed protein content | Seed biochemistry | HB | Altered seed protein content | 1024 | (31-91) |
| 1025 | G264 | Seed protein content | Seed biochemistry | HS | Altered seed protein content | 1026 | (24-114) |
| 1027 | G32 | Seed protein content | Seed biochemistry | AP2 | Altered seed protein content | 1028 | (17-84) |
| 1029 | G436 | Seed protein content | Seed biochemistry | HB | Altered seed protein content | 1030 | (22-85) |
| 1031 | G556 | Seed protein content | Seed biochemistry | bZIP | Altered seed protein content | 1032 | (83-143) |
| 1033 | G1420 | Seed protein content | Seed biochemistry | WRKY | Altered seed protein content | 1034 | (221-280) |
| 1035 | G1412 | Seed protein content | Seed biochemistry | NAC | Altered seed protein content | 1036 | (17-159) |
| 1037 | G738 | Seed protein content | Seed biochemistry | Z-Dof | Altered seed protein content | 1038 | (351-393) |
| 1039 | G2426 | Seed protein content | Seed biochemistry | MYB-(R1)R2R3 | Altered seed protein content | 1040 | (14-114) |
| 1041 | G1524 | Seed protein content | Seed biochemistry | RING/C3HC4 | Altered seed protein content | 1042 | (49-110) |
| 1043 | G1243 | Seed protein content | Seed biochemistry | SWI/SNF | Altered seed protein content | 1044 | (216-609) |
| 1045 | G631 | Seed protein content | Seed biochemistry | bZIP | Altered seed protein content | 1046 | (TBD) |
| 1047 | G1909 | Seed protein content | Seed biochemistry | Z-Dof | Altered seed protein content | 1048 | (23-51) |
| 1049 | G1663 | Seed protein content | Seed biochemistry | PCF | Altered seed protein content | 1050 | (TBD) |
| 1051 | G1231 | Seed protein content | Seed biochemistry | Z-C4HC3 | Altered seed protein content | 1052 | (TBD) |
| 1053 | G227 | Seed protein content | Seed biochemistry | MYB-(R1)R2R3 | Altered seed protein content | 1054 | (13-112) |
| 1055 | G1842 | Seed protein content | Seed biochemistry | MADS | Altered seed protein content | 1056 | (2-57) |
| 1057 | G1505 | Seed protein content | Seed biochemistry | GATA/Zn | Altered seed protein content | 1058 | (TBD) |
| 1059 | G657 | Seed protein content | Seed biochemistry | MYB-(R1)R2R3 | Altered seed protein content | 1060 | (TBD) |
| 1061 | G1959 | Seed protein content | Seed biochemistry | GARP | Altered seed protein content | 1062 | (46-97) |
| 1063 | G2180 | Seed protein content | Seed biochemistry | NAC | Altered seed protein content | 1064 | (7-156) |
| 1065 | G1817 | Seed protein content | Seed biochemistry | PMR | Altered seed protein content | 1066 | (47-331) |
| 1067 | G1649 | Seed protein content | Seed biochemistry | HLH/MYC | Altered seed protein content | 1068 | (225-295) |
| 1069 | G2131 | Seed protein content | Seed biochemistry | AP2 | Altered seed protein content | 1070 | (50-186, 112-183) |
| 1071 | G215 | Seed protein content | Seed biochemistry | MYB-related | Altered seed protein content | 1072 | (TBD) |
| 1073 | G1508 | Seed protein content | Seed biochemistry | GATA/Zn | Altered seed protein content | 1074 | (38-63) |
| 1075 | G2110 | Seed protein content | Seed biochemistry | WRKY | Altered seed protein content | 1076 | (239-298) |
| 1077 | G2442 | Seed protein content | Seed biochemistry | RING/C3HC4 | Altered seed protein content | 1078 | (220-246) |
| 1079 | G1051 | Flowering time | Flowering time | bZIP | Late flowering | 1080 | (189-250) |
| 1081 | G1052 | Flowering time | Flowering time | bZIP | Late flowering | 1082 | (201-261) |
| 1083 | G1079 | Flowering time; seed protein content | Flowering time; seed biochemistry | BZIPT2 | Late flowering; altered seed protein content | 1084 | (1-50) |

TABLE 5-continued

Genes, traits, transcription factor families and conserved domains

| Poly-nucleotide SEQ ID NO: | GID No. | Trait | Category | Family | Comment | Polypeptide SEQ ID NO: | Conserved domains |
|---|---|---|---|---|---|---|---|
| 1085 | G1335 | Flowering time | Flowering time | Z-CLDSH | Late flowering, slow growth | 1086 | (24-43, 131-144, 185-203) |
| 1087 | G157 | Flowering time | Flowering time | MADS | Altered flowering; significant overexpression delays flowering time | 1088 | (2-57) |
| 1089 | G1895 | Flowering time | Flowering time | Z-Dof | Late flowering | 1090 | (55-110) |
| 1091 | G1900 | Flowering time | Flowering time | Z-Dof | Late flowering | 1092 | (54-106) |
| 1093 | G2007 | Flowering time; seed protein content | Flowering time; seed biochemistry | MYB-(R1)R2R3 | Late flowering; altered seed protein content | 1094 | (TBD) |
| 1095 | G214 | Flowering time | Flowering time | MYB-related | Late flowering | 1096 | (22-71) |
| 1097 | G2155 | Flowering time | Flowering time | AT-hook | Late flowering | 1098 | (18-38) |
| 1099 | G234 | Flowering time | Flowering time | MYB-(R1)R2R3 | Late flowering, small plant | 1100 | (14-115) |
| 1101 | G361 | Flowering time | Flowering time | Z-C2H2 | Late flowering | 1102 | (43-63) |
| 1103 | G562 | Flowering time | Flowering time | bZIP | Late flowering | 1104 | (253-315) |
| 1105 | G591 | Flowering time | Flowering time | HLH/MYC | Late flowering | 1106 | (143-240) |
| 1107 | G8 | Flowering time | Flowering time | AP2 | Late flowering | 1108 | (151-217, 243-296) |
| 1109 | G859 | Flowering time; seed protein content | Flowering time; seed biochemistry | MADS | Late flowering; altered seed protein content | 1110 | (TBD) |
| 1111 | G878 | Flowering time | Flowering time | WRKY | Late flowering | 1112 | (250-305, 415-475) |
| 1113 | G971 | Flowering time | Flowering time | AP2 | Late flowering | 1114 | (120-186) |
| 1115 | G975 | Flowering time; morphology: other | Flowering time; dev and morph | AP2 | Late flowering; glossy leaves | 1116 | (4-71) |
| 1117 | G994 | Flowering time | Flowering time | MYB-(R1)R2R3 | Late flowering, small | 1118 | (14-123) |
| 1119 | G2347 | Flowering time | Flowering time | SBP | Late flowering, small | 1120 | (60-136) |
| 1121 | G2010 | Flowering time | Flowering time | SBP | Late flowering | 1122 | (53-127) |

TABLE 6

Genes, traits and utilities that affect plant characteristics

| Trait Category | Traits | Transcription factor genes that impact traits | Utility Gene effect on: |
|---|---|---|---|
| Resistance and tolerance | Salt stress resistance | G22; G196; G226; G303; G312; G325; G353; G482; G545; G801; G867; G884; G922; G926; G1452; G1794; G1820; G1836; G1843; G1863; G2053; G2110; G2140; G2153; G2379; G2701; G2713; G2719; G2789 | Germination rate, survivability, yield; extended growth range |
| | Osmotic stress resistance | G47; G175; G188; G303; G325; G353; G489; G502; G526; G921; G922; G926; G1069; G1089; G1452; G1794; G1930; G2140; G2153; G2379; G2701; G2719; G2789; | Germination rate, survivability, yield |
| | Cold stress resistance; cold germination | G256; G394; G664; G864; G1322; G2130 | Germination, growth, earlier planting |

TABLE 6-continued

Genes, traits and utilities that affect plant characteristics

| Trait Category | Traits | Transcription factor genes that impact traits | Utility Gene effect on: |
|---|---|---|---|
| | Tolerance to freezing | G303; G325; G353; G720; G912; G913; G1794; G2053; G2140; G2153; G2379; G2701; G2719; G2789 | Survivability, yield, appearance, extended range |
| | Heat stress resistance | G3; G464; G682; G864; G964; G1305; G1645; G2130 G2430 | Germination, growth, later planting |
| | Drought, low humidity resistance | G303; G325; G353; G720; G912; G926; G1452; G1794; G1820; G1843; G2053; G2140; G2153; G2379; G2583; G2701; G2719; G2789 | Survivability, yield, extended range |
| | Radiation resistance | G1052 | Survivability, vigor, appearance |
| | Decreased herbicide sensitivity | G343; G2133; G2517 | Resistant to increased herbicide use |
| | Increased herbicide sensitivity | G374; G877; G1519 | Use as a herbicide target |
| | Oxidative stress | G477; G789; G1807; G2133; G2517 | Improved yield, appearance, reduced senescence |
| | Light response | G183; G354; G375; G1062; G1322; G1331; G1488; G1494; G1521; G1786; G1794; G2144; G2555; | Germination, growth, development, flowering time |
| Development, morphology | Overall plant architecture | G24; G27; G31; G33; G47; G147; G156; G160; G182; G187; G195; G196; G211; G221; G237; G280; G342; G352; G357; G358; G360; G362; G364; G365; G367; G373; G377; G396; G431; G447; G479; G546; G546; G551; G578; G580; G596; G615; G617; G620; G625; G638; G658; G716; G725; G727; G730; G740; G770; G858; G865; G869; G872; G904; G910; G912; G920; G939; G963; G977; G979; G987; G988; G993; G1007; G1010; G1014; G1035; G1046; G1049; G1062; G1069; G1070; G1076; G1089; G1093; G1127; G1131; G1145; G1229; G1246; G1304; G1318; G1320; G1330; G1331; G1352; G1354; G1360; G1364; G1379; G1384; G1399; G1415; G1417; G1442; G1453; G1454; G1459; G1460; G1471; G1475; G1477; G1487; G1487; G1492; G1499; G1499; G1531; G1540; G1543; G1543; G1544; G1548; G1584; G1587; G1588; G1589; G1636; G1642; G1747; G1749; G1749; G1751; G1752; G1763; G1766; G1767; G1778; G1789; G1790; G1791; G1793; G1794; G1795; G1800; G1806; G1811; G1835; G1836; G1838; G1839; G1843; G1853; G1855; G1865; G1881; G1882; G1883; G1884; G1891; G1896; G1898; G1902; G1904; G1906; G1913; G1914; G1925; G1929; G1930; G1954; G1958; G1965; G1976; G2057; G2107; G2133; G2134; G2151; G2154; G2157; G2181; G2290; G2299; G2340; G2340; G2346; G2373; G2376; G2424; G2465; G2505; G2509; G2512; G2513; G2519; G2520; G2533; G2534; G2573; G2589; G2687; G2720; G2787; G2789; G2893 | Vascular tissues, lignin content; cell wall content; appearance |
| | Size: increased stature | G189; G1073; G1435; G2430 | |
| | Size: reduced stature or dwarfism | G3; G5; G21; G23; G39; G165; G184; G194; G258; G280; G340; G343; G353; G354; G362; G363; G370; G385; G396; G439; G440; G447; G450; G550; G557; G599; | Ornamental; small stature provides wind resistance; creation of dwarf varieties |

TABLE 6-continued

Genes, traits and utilities that affect plant characteristics

| Trait Category | Traits | Transcription factor genes that impact traits | Utility Gene effect on: |
|---|---|---|---|
| | | G636; G652; G670; G671; G674; G729; G760; G804; G831; G864; G884; G898; G900; G912; G913; G922; G932; G937; G939; G960; G962; G977; G991; G1000; G1008; G1020; G1023; G1053; G1067; G1075; G1137; G1181; G1198; G1228; G1266; G1267; G1275; G1277; G1309; G1311; G1314; G1317; G1322; G1323; G1326; G1332; G1334; G1367; G1381; G1382; G1386; G1421; G1488; G1494; G1537; G1545; G1560; G1586; G1641; G1652; G1655; G1671; G1750; G1756; G1757; G1782; G1786; G1794; G1839; G1845; G1879; G1886; G1888; G1933; G1939; G1943; G1944; G2011; G2094; G2115; G2130; G2132; G2144; G2145; G2147; G2156; G2294; G2313; G2344; G2431; G2510; G2517; G2521; G2893; G2893 | |
| | Fruit size and number | G362 | Biomass, yield, cotton boll fiber density |
| | Flower structure, inflorescence | G47; G259; G353; G354; G671; G732; G988; G1000; G1063; G1140; G1326; G1449; G1543; G1560; G1587; G1645; G1947; G2108; G2143; G2893 | Ornamental horticulture; production of saffron or other edible flowers |
| | Number and development of trichomes | G225; G226; G247; G362; G585; G634; G676; G682; G1014; G1332; G1452; G1795; G2105 | Resistance to pests and desiccation; essential oil production |
| | Seed size, color, and number | G156; G450; G584; G652; G668; G858; G979; G1040; G1062; G1145; G1255; G1494; G1531; G1534; G1594; G2105; G2114; | Yield |
| | Root development, modifications | G9; G1482; G1534; G1794; G1852; G2053; G2136; G2140 | |
| | Modifications to root hairs | G225; G226 | Nutrient, water uptake, pathogen resistance |
| | Apical dominance | G559; G732; G1255; G1275; G1411; G1488; G1635; G2452; G2509 | Ornamental horticulture |
| | Branching patterns | G568; G988; G1548 | Ornamental horticulture, knot reduction, improved windscreen |
| | Leaf shape, color, modifications | G375; G377; G428; G438; G447; G464; G557; G577; G599; G635; G671; G674; G736; G804; G903; G977; G921; G922; G1038; G1063; G1067; G1073; G1075; G1146; G1152; G1198; G1267; G1269; G1452; G1484; G1586; G1594; G1767; G1786; G1792; G1886; G2059; G2094; G2105; G2113; G2117; G2143; G2144; G2431; G2452; G2465; G2587; G2583; G2724; | Appealing shape or shiny leaves for ornamental agriculture, increased biomass or photosynthesis |
| | Silique | G1134 | Ornamental |
| | Stem morphology | G47; G438; G671; G748; G988; G1000 | Ornamental; digestibility |
| | Shoot modifications | G390; G391 | Ornamental stem bifurcations |
| Disease, Pathogen Resistance | Bacterial | G211; G347; G367; G418; G525; G545; G578; G1049 | Yield, appearance, survivability, extended range |
| | Fungal | G19; G28; G28; G28; G147; G188; G207; G211; G237; G248; G278; G347; G367; G371; G378; G409; G477; G545; G545; G558; G569; G578; G591; G594; G616; G789; G805; G812; G865; G869; G872; | Yield, appearance, survivability, extended range |

TABLE 6-continued

Genes, traits and utilities that affect plant characteristics

| Trait Category | Traits | Transcription factor genes that impact traits | Utility Gene effect on: |
|---|---|---|---|
| | | G881; G896; G940; G1047; G1049; G1064; G1084; G1196; G1255; G1266; G1363; G1514; G1756; G1792; G1792; G1792; G1792; G1880; G1919; G1919; G1927; G1927; G1936; G1936; G1950; G2069; G2130; G2380; G2380; G2555 | |
| Nutrients | Increased tolerance to nitrogen-limited soils | G225; G226; G1792 | |
| | Increased tolerance to phosphate-limited soils | G419; G545; G561; G1946 | |
| | Increased tolerance to potassium-limited soils | G561; G911 | |
| Hormonal | Hormone sensitivity | G12; G546; G926; G760; G913; G926; G1062; G1069; G1095; G1134; G1330; G1452; G1666; G1820; G2140; G2789 | Seed dormancy, drought tolerance; plant form, fruit ripening |
| Seed biochemistry | Production of seed prenyl lipids, including tocopherol | G214; G259; G490; G652; G748; G883; G1052; G1328; G1930; G2509; G2520 | Antioxidant activity, vitamin E |
| | Production of seed sterols | G20 | Precursors for human steroid hormones; cholesterol modulators |
| | Production of seed glucosinolates | G353; G484; G674; G1272; G1506; G1897; G1946; G2113; G2117; G2155; G2290; G2340 | Defense against insects; putative anticancer activity; undesirable in animal feeds |
| | Modified seed oil content | G162; G162; G180; G192; G241; G265; G286; G291; G427; G509; G519; G561; G567; G590; G818; G849; G892; G961; G974; G1063; G1143; G1190; G1198; G1226; G1229; G1323; G1451; G1471; G1478; G1496; G1526; G1543; G1640; G1644; G1646; G1672; G1677; G1750; G1765; G1777; G1793; G1838; G1902; G1946; G1948; G2059; G2123; G2138; G2139; G2343; G2792; G2830 | Vegetable oil production; increased caloric value for animal feeds; lutein content |
| | Modified seed oil composition | G217; G504; G622; G778; G791; G861; G869; G938; G965; G1417; G2192 | Heat stability, digestibility of seed oils |
| | Modified seed protein content | G162; G226; G241; G371; G427; G509; G567; G597; G732; G849; G865; G892; G963; G988; G1323; G1323; G1419; G1478; G1488; G1634; G1637; G1641; G1644; G1652; G1677; G1777; G1777; G1818; G1820; G1903; G1909; G1946; G1946; G1958; G2059; G2117; G2417; G2509 | Reduced caloric value for humans |
| Leaf biochemistry | Production of flavonoids | G1666* | Ornamental pigment production; pathogen resistance; health benefits |
| | Production of leaf glucosinolates | G264; G353; G484; G652; G674; G681; G1069; G1198; G1322; G1421; G1657; G1794; G1897; G1946; G2115; G2117; G2144; G2155; G2155; G2340; G2512; G2520; G2552 | Defense against insects; putative anticancer activity; undesirable in animal feeds |
| | Production of diterpenes | G229 | Induction of enzymes involved in alkaloid biosynthesis |
| | Production of anthocyanin | G546 | Ornamental pigment |
| | Production of leaf phytosterols, inc. stigmastanol, campesterol | G561; G2131; G2424 | Precursors for human steroid hormones; cholesterol modulators |
| | Leaf fatty acid composition | G214; G377; G861; G962; G975; G987; G1266; G1337; G1399; G1465; G1512; G2136; G2147; G2192 | Nutritional value; increase in waxes for disease resistance |

TABLE 6-continued

Genes, traits and utilities that affect plant characteristics

| Trait Category | Traits | Transcription factor genes that impact traits | Utility Gene effect on: |
|---|---|---|---|
| | Production of leaf prenyl lipids, including tocopherol | G214; G259; G280; G652; G987; G1543; G2509; G2520 | Antioxidant activity, vitamin E |
| Biochemistry, general | Production of miscellaneous secondary metabolites | G229; G663 | |
| | Sugar, starch, hemicellulose composition, | G158; G211; G211; G237; G242; G274; G598; G1012; G1266; G1309; G1309; G1641; G1765; G1865; G2094; G2094; G2589; G2589 | Food digestibility, hemicellulose & pectin content; fiber content; plant tensile strength, wood quality, pathogen resistance, pulp production; tuber starch content |
| Sugar sensing | Plant response to sugars | G26; G38; G43; G207; G218; G241; G254; G263; G308; G536; G567; G567; G680; G867; G912; G956; G996; G1068; G1225; G1314; G1314; G1337; G1759; G1804; G2153; G2379 | Photosynthetic rate, carbohydrate accumulation, biomass production, source-sink relationships, senescence |
| Growth, Reproduction | Plant growth rate and development | G447; G617; G674; G730; G917; G937; G1035; G1046; G1131; G1425; G1452; G1459; G1492; G1589; G1652; G1879; G1943; G2430; G2431; G2465; G2521 | Faster growth, increased biomass or yield, improved appearance; delay in bolting |
| | Embryo development | G167 | |
| | Seed germination rate | G979; G1792; G2130 | Yield |
| | Plant, seedling vigor | G561; G2346 | Survivability, yield |
| | Senescence; cell death | G571; G636; G878; G1050; G1463; G1749; G1944; G2130; G2155; G2340; G2383 | Yield, appearance; response to pathogens; |
| | Modified fertility | G39; G340; G439; G470; G559; G615; G652; G671; G779; G962; G977; G988; G1000; G1063; G1067; G1075; G1266; G1311; G1321; G1326; G1367; G1386; G1421; G1453; G1471; G1453; G1560; G1594; G1635; G1750; G1947; G2011; G2094; G2113; G2115; G2130; G2143; G2147; G2294; G2510; G2893 | Prevents or minimizes escape of the pollen of GMOs |
| | Early flowering | G147; G157; G180; G183; G183; G184; G185; G208; G227; G294; G390; G390; G390; G391; G391; G427; G427; G490; G565; G590; G592; G720; G789; G865; G898; G898; G989; G989; G1037; G1037; G1142; G1225; G1225; G1226; G1242; G1305; G1305; G1380; G1380; G1480; G1480; G1488; G1494; G1545; G1545; G1649; G1706; G1760; G1767; G1767; G1820; G1841; G1841; G1842; G1843; G1843; G1946; G1946; G2010; G2030; G2030; G2144; G2144; G2295; G2295; G2347; G2348; G2348; G2373; G2373; G2509; G2509; G2555; G2555 | Faster generation time; synchrony of flowering; potential for introducing new traits to single variety |
| | Delayed flowering | G8; G47; G192; G214; G234; G361; G362; G562; G568; G571; G591; G680; G736; G748; G859; G878; G910; G912; G913; G971; G994; G1051; G1052; G1073; G1079; G1335; G1435; G1452; G1478; G1789; G1804; G1865; G1865; G1895; G1900; G2007; G2133; G2155; G2291; G2465 | Delayed time to pollen production of GMO plants; synchrony of flowering; increased yield |
| | Extended flowering phase | G1947 | |
| | Flower and leaf development | G259; G353; G377; G580; G638; G652; G858; G869; G917; G922; G932; G1063; G1075; G1140; G1425; G1452; G1499; G1548; G1645; G1865; G1897; G1933; | Ornamental applications; decreased fertility |

TABLE 6-continued

Genes, traits and utilities that affect plant characteristics

| Trait Category | Traits | Transcription factor genes that impact traits | Utility Gene effect on: |
|---|---|---|---|
| | | G2094; G2124; G2140; G2143; G2535; G2557 | |
| | Flower abscission | G1897 | Ornamental: longer retention of flowers |

*When co-expressed with G669 and G663

Significance of Modified Plant Traits

Currently, the existence of a series of maturity groups for different latitudes represents a major barrier to the introduction of new valuable traits. Any trait (e.g. disease resistance) has to be bred into each of the different maturity groups separately, a laborious and costly exercise. The availability of single strain, which could be grown at any latitude, would therefore greatly increase the potential for introducing new traits to crop species such as soybean and cotton.

For many of the traits, listed in Table 6 and below, that may be conferred to plants, a single transcription factor gene may be used to increase or decrease, advance or delay, or improve or prove deleterious to a given trait. For example, overexpression of a transcription factor gene that naturally occurs in a plant may cause early flowering relative to non-transformed or wild-type plants. By knocking out the gene, or suppressing the gene (with, for example, antisense suppression) the plant may experience delayed flowering. Similarly, overexpressing or suppressing one or more genes can impart significant differences in production of plant products, such as different fatty acid ratios. Thus, suppressing a gene that causes a plant to be more sensitive to cold may improve a plant's tolerance of cold.

Salt stress resistance. Soil salinity is one of the more important variables that determines where a plant may thrive. Salinity is especially important for the successful cultivation of crop plants, particular in many parts of the world that have naturally high soil salt concentrations, or where the soil has been over-utilized. Thus, presently disclosed transcription factor genes that provide increased salt tolerance during germination, the seedling stage, and throughout a plant's life cycle would find particular value for imparting survivability and yield in areas where a particular crop would not normally prosper.

Osmotic stress resistance. Presently disclosed transcription factor genes that confer resistance to osmotic stress may increase germination rate under adverse conditions, which could impact survivability and yield of seeds and plants.

Cold stress resistance. The potential utility of presently disclosed transcription factor genes that increase tolerance to cold is to confer better germination and growth in cold conditions. The germination of many crops is very sensitive to cold temperatures. Genes that would allow germination and seedling vigor in the cold would have highly significant utility in allowing seeds to be planted earlier in the season with a high rate of survivability. Transcription factor genes that confer better survivability in cooler climates allow a grower to move up planting time in the spring and extend the growing season further into autumn for higher crop yields.

Tolerance to freezing. The presently disclosed transcription factor genes that impart tolerance to freezing conditions are useful for enhancing the survivability and appearance of plants conditions or conditions that would otherwise cause extensive cellular damage. Thus, germination of seeds and survival may take place at temperatures significantly below that of the mean temperature required for germination of seeds and survival of non-transformed plants. As with salt tolerance, this has the added benefit of increasing the potential range of a crop plant into regions in which it would otherwise succumb. Cold tolerant transformed plants may also be planted earlier in the spring or later in autumn, with greater success than with non-transformed plants.

Heat stress tolerance. The germination of many crops is also sensitive to high temperatures. Presently disclosed transcription factor genes that provide increased heat tolerance are generally useful in producing plants that germinate and grow in hot conditions, may find particular use for crops that are planted late in the season, or extend the range of a plant by allowing growth in relatively hot climates.

Drought, low humidity tolerance. Strategies that allow plants to survive in low water conditions may include, for example, reduced surface area or surface oil or wax production. A number of presently disclosed transcription factor genes increase a plant's tolerance to low water conditions and provide the benefits of improved survivability, increased yield and an extended geographic and temporal planting range.

Radiation resistance. Presently disclosed transcription factor genes have been shown to increase lutein production. Lutein, like other xanthophylls such as zeaxanthin and violaxanthin, are important in the protection of plants against the damaging effects of excessive light. Lutein contributes, directly or indirectly, to the rapid rise of non-photochemical quenching in plants exposed to high light. Increased tolerance of field plants to visible and ultraviolet light impacts survivability and vigor, particularly for recent transplants. Also affected are the yield and appearance of harvested plants or plant parts. Crop plants engineered with presently disclosed transcription factor genes that cause the plant to produce higher levels of lutein therefore would have improved photoprotection, leading to less oxidative damage and increase vigor, survivability and higher yields under high light and ultraviolet light conditions.

Decreased herbicide sensitivity. Presently disclosed transcription factor genes that confer resistance or tolerance to herbicides (e.g., glyphosate) may find use in providing means to increase herbicide applications without detriment to desirable plants. This would allow for the increased use of a particular herbicide in a local environment, with the effect of increased detriment to undesirable species and less harm to transgenic, desirable cultivars.

Increased herbicide sensitivity. Knockouts of a number of the presently disclosed transcription factor genes have been shown to be lethal to developing embryos. Thus, these genes are potentially useful as herbicide targets.

Oxidative stress. In plants, as in all living things, abiotic and biotic stresses induce the formation of oxygen radicals, including superoxide and peroxide radicals. This has the effect of accelerating senescence, particularly in leaves, with the resulting loss of yield and adverse effect on appearance. Generally, plants that have the highest level of defense mechanisms, such as, for example, polyunsaturated moieties of membrane lipids, are most likely to thrive under conditions that introduce oxidative stress (e.g., high light, ozone, water deficit, particularly in combination). Introduction of the presently disclosed transcription factor genes that increase the level of oxidative stress defense mechanisms would provide beneficial effects on the yield and appearance of plants. One specific oxidizing agent, ozone, has been shown to cause significant foliar injury, which impacts yield and appearance of crop and ornamental plants. In addition to reduced foliar injury that would be found in ozone resistant plant created by transforming plants with some of the presently disclosed transcription factor genes, the latter have also been shown to have increased chlorophyll fluorescence (Yu-Sen Chang et al. Bot. Bull. Acad. Sin. (2001) 42: 265-272).

Heavy metal tolerance. Heavy metals such as lead, mercury, arsenic, chromium and others may have a significant adverse impact on plant respiration. Plants that have been transformed with presently disclosed transcription factor genes that confer improved resistance to heavy metals, through, for example, sequestering or reduced uptake of the metals will show improved vigor and yield in soils with relatively high concentrations of these elements. Conversely, transgenic transcription factors may also be introduced into plants to confer an increase in heavy metal uptake, which may benefit efforts to clean up contaminated soils.

Light response. Presently disclosed transcription factor genes that modify a plant's response to light may be useful for modifying a plant's growth or development, for example, photomorphogenesis in poor light, or accelerating flowering time in response to various light intensities, quality or duration to which a non-transformed plant would not similarly respond. Examples of such responses that have been demonstrated include leaf number and arrangement, and early flower bud appearances.

Overall plant architecture. Several presently disclosed transcription factor genes have been introduced into plants to alter numerous aspects of the plant's morphology. For example, it has been demonstrated that a number of transcription factors may be used to manipulate branching, such as the means to modify lateral branching, a possible application in the forestry industry. Transgenic plants have also been produced that have altered cell wall content, lignin production, flower organ number, or overall shape of the plants. Presently disclosed transcription factor genes transformed into plants may be used to affect plant morphology by increasing or decreasing internode distance, both of which may be advantageous under different circumstances. For example, for fast growth of woody plants to provide more biomass, or fewer knots, increased internode distances are generally desirable. For improved wind screening of shrubs or trees, or harvesting characteristics of, for example, members of the Gramineae family, decreased internode distance may be advantageous. These modifications would also prove useful in the ornamental horticulture industry for the creation of unique phenotypic characteristics of ornamental plants.

Increased stature. For some ornamental plants, the ability to provide larger varieties may be highly desirable. For many plants, including t fruit-bearing trees or trees and shrubs that serve as view or wind screens, increased stature provides obvious benefits. Crop species may also produce higher yields on larger cultivars.

Reduced stature or dwarfism. Presently disclosed transcription factor genes that decrease plant stature can be used to produce plants that are more resistant to damage by wind and rain, or more resistant to heat or low humidity or water deficit. Dwarf plants are also of significant interest to the ornamental horticulture industry, and particularly for home garden applications for which space availability may be limited.

Fruit size and number. Introduction of presently disclosed transcription factor genes that affect fruit size will have desirable impacts on fruit size and number, which may comprise increases in yield for fruit crops, or reduced fruit yield, such as when vegetative growth is preferred (e.g., with bushy ornamentals, or where fruit is undesirable, as with ornamental olive trees).

Flower structure, inflorescence, and development. Presently disclosed transgenic transcription factors have been used to create plants with larger flowers or arrangements of flowers that are distinct from wild-type or non-transformed cultivars. This would likely have the most value for the ornamental horticulture industry, where larger flowers or interesting presentations generally are preferred and command the highest prices. Flower structure may have advantageous effects on fertility, and could be used, for example, to decrease fertility by the absence, reduction or screening of reproductive components. One interesting application for manipulation of flower structure, for example, by introduced transcription factors could be in the increased production of edible flowers or flower parts, including saffron, which is derived from the stigmas of *Crocus sativus*.

Number and development of trichomes. Several presently disclosed transcription factor genes have been used to modify trichome number and amount of trichome products in plants. Trichome glands on the surface of many higher plants produce and secrete exudates that give protection from the elements and pests such as insects, microbes and herbivores. These exudates may physically immobilize insects and spores, may be insecticidal or ant-microbial or they may act as allergens or irritants to protect against herbivores. Trichomes have also been suggested to decrease transpiration by decreasing leaf surface air flow, and by exuding chemicals that protect the leaf from the sun.

Seed size, color and number. The introduction of presently disclosed transcription factor genes into plants that alter the size or number of seeds may have a significant impact on yield, both when the product is the seed itself, or when biomass of the vegetative portion of the plant is increased by reducing seed production. In the case of fruit products, it is often advantageous to modify a plant to have reduced size or number of seeds relative to non-transformed plants to provide seedless or varieties with reduced numbers or smaller seeds. Presently disclosed transcription factor genes have also been shown to affect seed size, including the development of larger seeds. Seed size, in addition to seed coat integrity, thickness and permeability, seed water content and by a number of other components including antioxidants and oligosaccharides, may affect seed longevity in storage. This would be an important utility when the seed of a plant is the harvested crops, as with, for example, peas, beans, nuts, etc. Presently disclosed transcription factor genes have also been used to modify seed color, which could provide added appeal to a seed product.

Root development, modifications. By modifying the structure or development of roots by transforming into a plant one or more of the presently disclosed transcription factor genes, plants may be produced that have the capacity to thrive in otherwise unproductive soils. For example, grape roots that extend further into rocky soils, or that remain viable in waterlogged soils, would increase the effective planting range of the crop. It may be advantageous to manipulate a plant to produce short roots, as when a soil in which the plant will be growing is occasionally flooded, or when pathogenic fungi or disease-causing nematodes are prevalent.

Modifications to root hairs. Presently disclosed transcription factor genes that increase root hair length or number potentially could be used to increase root growth or vigor, which might in turn allow better plant growth under adverse conditions such as limited nutrient or water availability.

Apical dominance. The modified expression of presently disclosed transcription factors that control apical dominance could be used in ornamental horticulture, for example, to modify plant architecture.

Branching patterns. Several presently disclosed transcription factor genes have been used to manipulate branching, which could provide benefits in the forestry industry. For example, reduction in the formation of lateral branches could reduce knot formation. Conversely, increasing the number of lateral branches could provide utility when a plant is used as a windscreen, or may also provide ornamental advantages.

Leaf shape, color and modifications. It has been demonstrated in laboratory experiments that overexpression of some of the presently disclosed transcription factors produced marked effects on leaf development. At early stages of growth, these transgenic seedlings developed narrow, upward pointing leaves with long petioles, possibly indicating a disruption in circadian-clock controlled processes or nyctinastic movements. Other transcription factor genes can be used to increase plant biomass; large size would be useful in crops where the vegetative portion of the plant is the marketable portion.

Siliques. Genes that later silique conformation in brassicates may be used to modify fruit ripening processes in brassicates and other plants, which may positively affect seed or fruit quality.

Stem morphology and shoot modifications. Laboratory studies have demonstrated that introducing several of the presently disclosed transcription factor genes into plants can cause stem bifurcations in shoots, in which the shoot meristems split to form two or three separate shoots. This unique appearance would be desirable in ornamental applications.

Diseases, pathogens and pests. A number of the presently disclosed transcription factor genes have been shown to or are likely to confer resistance to various plant diseases, pathogens and pests. The offending organisms include fungal pathogens *Fusarium oxysporum, Botrytis cinerea, Sclerotinia sclerotiorum*, and *Erysiphe orontii*. Bacterial pathogens to which resistance may be conferred include *Pseudomonas syringae*. Other problem organisms may potentially include nematodes, mollicutes, parasites, or herbivorous arthropods. In each case, one or more transformed transcription factor genes may provide some benefit to the plant to help prevent or overcome infestation. The mechanisms by which the transcription factors work could include increasing surface waxes or oils, surface thickness, local senescence, or the activation of signal transduction pathways that regulate plant defense in response to attacks by herbivorous pests (including, for example, protease inhibitors).

Increased tolerance of plants to nutrient-limited soils. Presently disclosed transcription factor genes introduced into plants may provide the means to improve uptake of essential nutrients, including nitrogenous compounds, phosphates, potassium, and trace minerals. The effect of these modifications is to increase the seedling germination and range of ornamental and crop plants. The utilities of presently disclosed transcription factor genes conferring tolerance to conditions of low nutrients also include cost savings to the grower by reducing the amounts of fertilizer needed, environmental benefits of reduced fertilizer runoff; and improved yield and stress tolerance. In addition, this gene could be used to alter seed protein amounts and/or composition that could impact yield as well as the nutritional value and production of various food products.

Hormone sensitivity. One or more of the presently disclosed transcription factor genes have been shown to affect plant abscisic acid (ABA) sensitivity. This plant hormone is likely the most important hormone in mediating the adaptation of a plant to stress. For example, ABA mediates conversion of apical meristems into dormant buds. In response to increasingly cold conditions, the newly developing leaves growing above the meristem become converted into stiff bud scales that closely wrap the meristem and protect it from mechanical damage during winter. ABA in the bud also enforces dormancy; during premature warm spells, the buds are inhibited from sprouting. Bud dormancy is eliminated after either a prolonged cold period of cold or a significant number of lengthening days. Thus, by affecting ABA sensitivity, introduced transcription factor genes may affect cold sensitivity and survivability. ABA is also important in protecting plants from drought tolerance.

Several other of the present transcription factor genes have been used to manipulate ethylene signal transduction and response pathways. These genes can thus be used to manipulate the processes influenced by ethylene, such as seed germination or fruit ripening, and to improve seed or fruit quality.

Production of seed and leaf prenyl lipids, including tocopherol. Prenyl lipids play a role in anchoring proteins in membranes or membranous organelles. Thus modifying the prenyl lipid content of seeds and leaves could affect membrane integrity and function. A number of presently disclosed transcription factor genes have been shown to modify the tocopherol composition of plants. Tocopherols have both anti-oxidant and vitamin E activity.

Production of seed and leaf phytosterols: Presently disclosed transcription factor genes that modify levels of phytosterols in plants may have at least two utilities. First, phytosterols are an important source of precursors for the manufacture of human steroid hormones. Thus, regulation of transcription factor expression or activity could lead to elevated levels of important human steroid precursors for steroid semi-synthesis. For example, transcription factors that cause elevated levels of campesterol in leaves, or sitosterols and stigmasterols in seed crops, would be useful for this purpose. Phytosterols and their hydrogenated derivatives phytostanols also have proven cholesterol-lowering properties, and transcription factor genes that modify the expression of these compounds in plants would thus provide health benefits.

Production of seed and leaf glucosinolates. Some glucosinolates have anti-cancer activity; thus, increasing the levels or composition of these compounds by introducing several of the presently disclosed transcription factors might be of interest from a nutraceutical standpoint. (3) Glucosinolates form part of a plants natural defense against insects. Modification of glucosinolate composition or quantity could therefore afford increased protection from predators. Furthermore, in edible crops, tissue specific promoters might be used to ensure that these compounds accumulate specifically in tissues, such as the epidermis, which are not taken for consumption.

Modified seed oil content. The composition of seeds, particularly with respect to seed oil amounts and/or composition, is very important for the nutritional value and production of various food and feed products. Several of the presently disclosed transcription factor genes in seed lipid saturation that alter seed oil content could be used to improve the heat stability of oils or to improve the nutritional quality of seed oil, by, for example, reducing the number of calories in seed, increasing the number of calories in animal feeds, or altering the ratio of saturated to unsaturated lipids comprising the oils.

Seed and leaf fatty acid composition. A number of the presently disclosed transcription factor genes have been shown to alter the fatty acid composition in plants, and seeds in particular. This modification may find particular value for improving the nutritional value of, for example, seeds or whole plants. Dietary fatty acids ratios have been shown to have an effect on, for example, bone integrity and remodeling (see, for example, Weiler (2000) Pediatr Res 47:5 692-697). The ratio of dietary fatty acids may alter the precursor pools of long-chain polyunsaturated fatty acids that serve as precursors for prostaglandin synthesis. In mammalian connective tissue, prostaglandins serve as important signals regulating the balance between resorption and formation in bone and cartilage. Thus dietary fatty acid ratios altered in seeds may affect the etiology and outcome of bone loss.

Modified seed protein content. As with seed oils, the composition of seeds, particularly with respect to protein amounts and/or composition, is very important for the nutritional value and production of various food and feed products. A number of the presently disclosed transcription factor genes modify the protein concentrations in seeds would provide nutritional benefits, and may be used to prolong storage, increase seed pest or disease resistance, or modify germination rates.

Production of flavonoids in leaves and other plant parts. Expression of presently disclosed transcription factor genes that increase flavonoid production in plants, including anthocyanins and condensed tannins, may be used to alter in pigment production for horticultural purposes, and possibly increasing stress resistance. Flavonoids have antimicrobial activity and could be used to engineer pathogen resistance. Several flavonoid compounds have health promoting effects such as the inhibition of tumor growth and cancer, prevention of bone loss and the prevention of the oxidation of lipids. Increasing levels of condensed tannins, whose biosynthetic pathway is shared with anthocyanin biosynthesis, in forage legumes is an important agronomic trait because they prevent pasture bloat by collapsing protein foams within the rumen. For a review on the utilities of flavonoids and their derivatives, refer to Dixon et al. (1999) Trends Plant Sci. 4:394-400.

Production of diterpenes in leaves and other plant parts. Depending on the plant species, varying amounts of diverse secondary biochemicals (often lipophilic terpenes) are produced and exuded or volatilized by trichomes. These exotic secondary biochemicals, which are relatively easy to extract because they are on the surface of the leaf, have been widely used in such products as flavors and aromas, drugs, pesticides and cosmetics. Thus, the overexpression of genes that are used to produce diterpenes in plants may be accomplished by introducing transcription factor genes that induce said overexpression. One class of secondary metabolites, the diterpenes, can effect several biological systems such as tumor progression, prostaglandin synthesis and tissue inflammation. In addition, diterpenes can act as insect pheromones, termite allomones, and can exhibit neurotoxic, cytotoxic and antimitotic activities. As a result of this functional diversity, diterpenes have been the target of research several pharmaceutical ventures. In most cases where the metabolic pathways are impossible to engineer, increasing trichome density or size on leaves may be the only way to increase plant productivity.

Production of anthocyanin in leaves and other plant parts. Several presently disclosed transcription factor genes can be used to alter anthocyanin production in numerous plant species. The potential utilities of these genes include alterations in pigment production for horticultural purposes, and possibly increasing stress resistance in combination with another transcription factor.

Production of miscellaneous secondary metabolites. Microarray data suggests that flux through the aromatic amino acid biosynthetic pathways and primary and secondary metabolite biosynthetic pathways are up-regulated. Presently disclosed transcription factors have been shown to be involved in regulating alkaloid biosynthesis, in part by up-regulating the enzymes indole-3-glycerol phosphatase and strictosidine synthase. Phenylalanine ammonia lyase, chalcone synthase and trans-cinnamate mono-oxygenase are also induced, and are involved in phenylpropenoid biosynthesis.

Sugar, starch, hemicellulose composition. Overexpression of the presently disclosed transcription factors that affect sugar content resulted in plants with altered leaf insoluble sugar content. Transcription factors that alter plant cell wall composition have several potential applications including altering food digestibility, plant tensile strength, wood quality, pathogen resistance and in pulp production. The potential utilities of a gene involved in glucose-specific sugar sensing are to alter energy balance, photosynthetic rate, carbohydrate accumulation, biomass production, source-sink relationships, and senescence.

Hemicellulose is not desirable in paper pulps because of its lack of strength compared with cellulose. Thus modulating the amounts of cellulose vs. hemicellulose in the plant cell wall is desirable for the paper/lumber industry. Increasing the insoluble carbohydrate content in various fruits, vegetables, and other edible consumer products will result in enhanced fiber content. Increased fiber content would not only provide health benefits in food products, but might also increase digestibility of forage crops. In addition, the hemicellulose and pectin content of fruits and berries affects the quality of jam and catsup made from them. Changes in hemicellulose and pectin content could result in a superior consumer product.

Plant response to sugars and sugar composition. In addition to their important role as an energy source and structural component of the plant cell, sugars are central regulatory molecules that control several aspects of plant physiology, metabolism and development. It is thought that this control is achieved by regulating gene expression and, in higher plants, sugars have been shown to repress or activate plant genes involved in many essential processes such as photosynthesis, glyoxylate metabolism, respiration, starch and sucrose synthesis and degradation, pathogen response, wounding response, cell cycle regulation, pigmentation, flowering and senescence. The mechanisms by which sugars control gene expression are not understood.

Because sugars are important signaling molecules, the ability to control either the concentration of a signaling sugar or how the plant perceives or responds to a signaling sugar could be used to control plant development, physiology or metabolism. For example, the flux of sucrose (a disaccharide sugar used for systemically transporting carbon and energy in most plants) has been shown to affect gene expression and alter storage compound accumulation in seeds. Manipulation of the sucrose signaling pathway in seeds may therefore cause seeds to have more protein, oil or carbohydrate, depending on the type of manipulation. Similarly, in tubers, sucrose is converted to starch which is used as an energy store. It is thought that sugar signaling pathways may partially determine the levels of starch synthesized in the tubers. The manipulation of sugar signaling in tubers could lead to tubers with a higher starch content.

Thus, the presently disclosed transcription factor genes that manipulate the sugar signal transduction pathway may lead to altered gene expression to produce plants with desirable traits. In particular, manipulation of sugar signal transduction pathways could be used to alter source-sink relationships in seeds, tubers, roots and other storage organs leading to increase in yield.

Plant growth rate and development. A number of the presently disclosed transcription factor genes have been shown to have significant effects on plant growth rate and development. These observations have included, for example, more rapid or delayed growth and development of reproductive organs. This would provide utility for regions with short or long growing seasons, respectively. Accelerating plant growth would also improve early yield or increase biomass at an earlier stage, when such is desirable (for example, in producing forestry products).

Embryo development. Presently disclosed transcription factor genes that alter embryo development has been used to alter seed protein and oil amounts and/or composition which is very important for the nutritional value and production of various food products. Seed shape and seed coat may also be altered by these genes, which may provide for improved storage stability.

Seed germination rate. A number of the presently disclosed transcription factor genes have been shown to modify seed germination rate, including when the seeds are in conditions normally unfavorable for germination (e.g., cold, heat or salt stress, or in the presence of ABA), and may thus be used to modify and improve germination rates under adverse conditions.

Plant, seedling vigor. Seedlings transformed with presently disclosed transcription factors have been shown to possess larger cotyledons and appeared somewhat more advanced than control plants. This indicates that the seedlings developed more rapidly that the control plants. Rapid seedling development is likely to reduce loss due to diseases particularly prevalent at the seedling stage (e.g., damping off) and is thus important for survivability of plants germinating in the field or in controlled environments.

Senescence, cell death. Presently disclosed transcription factor genes may be used to alter senescence responses in plants. Although leaf senescence is thought to be an evolutionary adaptation to recycle nutrients, the ability to control senescence in an agricultural setting has significant value. For example, a delay in leaf senescence in some maize hybrids is associated with a significant increase in yields and a delay of a few days in the senescence of soybean plants can have a large impact on yield. Delayed flower senescence may also generate plants that retain their blossoms longer and this may be of potential interest to the ornamental horticulture industry.

Modified fertility. Plants that overexpress a number of the presently disclosed transcription factor genes have been shown to possess reduced fertility. This could be a desirable trait, as it could be exploited to prevent or minimize the escape of the pollen of genetically modified organisms (GMOs) into the environment.

Early and delayed flowering. Presently disclosed transcription factor genes that accelerate flowering could have valuable applications in such programs since they allow much faster generation times. In a number of species, for example, broccoli, cauliflower, where the reproductive parts of the plants constitute the crop and the vegetative tissues are discarded, it would be advantageous to accelerate time to flowering. Accelerating flowering could shorten crop and tree breeding programs. Additionally, in some instances, a faster generation time might allow additional harvests of a crop to be made within a given growing season. A number of Arabidopsis genes have already been shown to accelerate flowering when constitutively expressed. These include LEAFY, APETALA1 and CONSTANS (Mandel, M. et al., 1995, Nature 377, 522-524; Weigel, D. and Nilsson, O., 1995, Nature 377, 495-500; Simon et al., 1996, Nature 384, 59-62).

By regulating the expression of potential flowering using inducible promoters, flowering could be triggered by application of an inducer chemical. This would allow flowering to be synchronized across a crop and facilitate more efficient harvesting. Such inducible systems could also be used to tune the flowering of crop varieties to different latitudes. At present, species such as soybean and cotton are available as a series of maturity groups that are suitable for different latitudes on the basis of their flowering time (which is governed by day-length). A system in which flowering could be chemically controlled would allow a single high-yielding northern maturity group to be grown at any latitude. In southern regions such plants could be grown for longer, thereby increasing yields, before flowering was induced. In more northern areas, the induction would be used to ensure that the crop flowers prior to the first winter frosts.

In a sizeable number of species, for example, root crops, where the vegetative parts of the plants constitute the crop and the reproductive tissues are discarded, it would be advantageous to delay or prevent flowering. Extending vegetative development with presently disclosed transcription factor genes could thus bring about large increases in yields. Prevention of flowering might help maximize vegetative yields and prevent escape of genetically modified organism (GMO) pollen.

Extended flowering phase. Presently disclosed transcription factors that extend flowering time have utility in engineering plants with longer-lasting flowers for the horticulture industry, and for extending the time in which the plant is fertile.

Flower and leaf development. Presently disclosed transcription factor genes have been used to modify the development of flowers and leaves. This could be advantageous in the development of new ornamental cultivars that present unique configurations. In addition, some of these genes have been shown to reduce a plant's fertility, which is also useful for helping to prevent development of pollen of GMOs.

Flower abscission. Presently disclosed transcription factor genes introduced into plants have been used to retain flowers for longer periods. This would provide a significant benefit to the ornamental industry, for both cut flowers and woody plant varieties (of, for example, maize), as well as have the potential to lengthen the fertile period of a plant, which could positively impact yield and breeding programs.

A listing of specific effects and utilities that the presently disclosed transcription factor genes have on plants, as determined by direct observation and assay analysis, is provided in Table 5.

XVI. Antisense and Co-Suppression

In addition to expression of the nucleic acids of the invention as gene replacement or plant phenotype modification nucleic acids, the nucleic acids are also useful for sense and anti-sense suppression of expression, e.g., to down-regulate expression of a nucleic acid of the invention, e.g., as a further mechanism for modulating plant phenotype. That is, the nucleic acids of the invention, or subsequences or anti-sense sequences thereof, can be used to block expression of naturally occurring homologous nucleic acids. A variety of sense and anti-sense technologies are known in the art, e.g., as set forth in Lichtenstein and Nellen (1997) *Antisense Technology*: A Practical Approach IRL Press at Oxford University Press, Oxford, U.K. In general, sense or anti-sense sequences are introduced into a cell, where they are optionally amplified, e.g., by transcription. Such sequences include both simple oligonucleotide sequences and catalytic sequences such as ribozymes.

For example, a reduction or elimination of expression (i.e., a "knock-out") of a transcription factor or transcription factor homologue polypeptide in a transgenic plant, e.g., to modify a plant trait, can be obtained by introducing an antisense construct corresponding to the polypeptide of interest as a cDNA. For antisense suppression, the transcription factor or homologue cDNA is arranged in reverse orientation (with respect to the coding sequence) relative to the promoter sequence in the expression vector. The introduced sequence need not be the full length cDNA or gene, and need not be identical to the cDNA or gene found in the plant type to be transformed. Typically, the antisense sequence need only be capable of hybridizing to the target gene or RNA of interest. Thus, where the introduced sequence is of shorter length, a higher degree of homology to the endogenous transcription factor sequence will be needed for effective antisense suppression. While antisense sequences of various lengths can be utilized, preferably, the introduced antisense sequence in the vector will be at least 30 nucleotides in length, and improved antisense suppression will typically be observed as the length of the antisense sequence increases. Preferably, the length of the antisense sequence in the vector will be greater than 100 nucleotides. Transcription of an antisense construct as described results in the production of RNA molecules that are the reverse complement of mRNA molecules transcribed from the endogenous transcription factor gene in the plant cell.

Suppression of endogenous transcription factor gene expression can also be achieved using a ribozyme. Ribozymes are RNA molecules that possess highly specific endoribonuclease activity. The production and use of ribozymes are disclosed in U.S. Pat. No. 4,987,071 and U.S. Pat. No. 5,543,508. Synthetic ribozyme sequences including antisense RNAs can be used to confer RNA cleaving activity on the antisense RNA, such that endogenous mRNA molecules that hybridize to the antisense RNA are cleaved, which in turn leads to an enhanced antisense inhibition of endogenous gene expression.

Vectors in which RNA encoded by a transcription factor or transcription factor homologue cDNA is over-expressed can also be used to obtain co-suppression of a corresponding endogenous gene, e.g., in the manner described in U.S. Pat. No. 5,231,020 to Jorgensen. Such co-suppression (also termed sense suppression) does not require that the entire transcription factor cDNA be introduced into the plant cells, nor does it require that the introduced sequence be exactly identical to the endogenous transcription factor gene of interest. However, as with antisense suppression, the suppressive efficiency will be enhanced as specificity of hybridization is increased, e.g., as the introduced sequence is lengthened, and/or as the sequence similarity between the introduced sequence and the endogenous transcription factor gene is increased.

Vectors expressing an untranslatable form of the transcription factor mRNA, e.g., sequences comprising one or more stop codon, or nonsense mutation) can also be used to suppress expression of an endogenous transcription factor, thereby reducing or eliminating it's activity and modifying one or more traits. Methods for producing such constructs are described in U.S. Pat. No. 5,583,021. Preferably, such constructs are made by introducing a premature stop codon into the transcription factor gene. Alternatively, a plant trait can be modified by gene silencing using double-strand RNA (Sharp (1999) *Genes and Development* 13: 139-141). Another method for abolishing the expression of a gene is by insertion mutagenesis using the T-DNA of *Agrobacterium tumefaciens*. After generating the insertion mutants, the mutants can be screened to identify those containing the insertion in a transcription factor or transcription factor homologue gene. Plants containing a single transgene insertion event at the desired gene can be crossed to generate homozygous plants for the mutation. Such methods are well known to those of skill in the art. (See for example Koncz et al. (1992) *Methods in Arabidopsis Research*, World Scientific.)

Alternatively, a plant phenotype can be altered by eliminating an endogenous gene, such as a transcription factor or transcription factor homologue, e.g., by homologous recombination (Kempin et al. (1997) *Nature* 389:802-803).

A plant trait can also be modified by using the Cre-lox system (for example, as described in U.S. Pat. No. 5,658,772). A plant genome can be modified to include first and second lox sites that are then contacted with a Cre recombinase. If the lox sites are in the same orientation, the intervening DNA sequence between the two sites is excised. If the lox sites are in the opposite orientation, the intervening sequence is inverted.

The polynucleotides and polypeptides of this invention can also be expressed in a plant in the absence of an expression cassette by manipulating the activity or expression level of the endogenous gene by other means. For example, by ectopically expressing a gene by T-DNA activation tagging (Ichikawa et al. (1997) *Nature* 390 698-701; Kakimoto et al. (1996) *Science* 274: 982-985). This method entails transforming a plant with a gene tag containing multiple transcriptional enhancers and once the tag has inserted into the genome, expression of a flanking gene coding sequence becomes deregulated. In another example, the transcriptional machinery in a plant can be modified so as to increase transcription levels of a polynucleotide of the invention (See, e.g., PCT Publications WO 96/06166 and WO 98/53057 which describe the modification of the DNA-binding specificity of zinc finger proteins by changing particular amino acids in the DNA-binding motif).

The transgenic plant can also include the machinery necessary for expressing or altering the activity of a polypeptide encoded by an endogenous gene, for example by altering the phosphorylation state of the polypeptide to maintain it in an activated state.

Transgenic plants (or plant cells, or plant explants, or plant tissues) incorporating the polynucleotides of the invention and/or expressing the polypeptides of the invention can be produced by a variety of well established techniques as described above. Following construction of a vector, most typically an expression cassette, including a polynucleotide, e.g., encoding a transcription factor or transcription factor homologue, of the invention, standard techniques can be used to introduce the polynucleotide into a plant, a plant cell, a plant explant or a plant tissue of interest. Optionally, the plant cell, explant or tissue can be regenerated to produce a transgenic plant.

The plant can be any higher plant, including gymnosperms, monocotyledonous and dicotyledenous plants. Suitable protocols are available for Leguminosae (alfalfa, soybean, clover, etc.), Umbelliferae (carrot, celery, parsnip), Cruciferae (cabbage, radish, rapeseed, broccoli, etc.), Curcurbitaceae (melons and cucumber), Gramineae (wheat, corn, rice, barley, millet, etc.), Solanaceae (potato, tomato, tobacco, peppers, etc.), and various other crops. See protocols described in Ammirato et al. (1984) *Handbook of Plant Cell Culture—Crop Species*, Macmillan Publ. Co. Shimamoto et al. (1989) *Nature* 338:274-276; Fromm et al. (1990) *Bio/Technology* 8:833-839; and Vasil et al. (1990) *Bio/Technology* 8:429-434.

Transformation and regeneration of both monocotyledonous and dicotyledonous plant cells is now routine, and the selection of the most appropriate transformation technique will be determined by the practitioner. The choice of method will vary with the type of plant to be transformed; those skilled in the art will recognize the suitability of particular methods for given plant types. Suitable methods can include, but are not limited to: electroporation of plant protoplasts; liposome-mediated transformation; polyethylene glycol (PEG) mediated transformation; transformation using viruses; micro-injection of plant cells; micro-projectile bombardment of plant cells; vacuum infiltration; and *Agrobacterium tumefaciens* mediated transformation. Transformation means introducing a nucleotide sequence into a plant in a manner to cause stable or transient expression of the sequence.

Successful examples of the modification of plant characteristics by transformation with cloned sequences which serve to illustrate the current knowledge in this field of technology, and which are herein incorporated by reference, include: U.S. Pat. Nos. 5,571,706; 5,677,175; 5,510,471; 5,750,386; 5,597,945; 5,589,615; 5,750,871; 5,268,526; 5,780,708; 5,538,880; 5,773,269; 5,736,369 and 5,610,042.

Following transformation, plants are preferably selected using a dominant selectable marker incorporated into the transformation vector. Typically, such a marker will confer antibiotic or herbicide resistance on the transformed plants, and selection of transformants can be accomplished by exposing the plants to appropriate concentrations of the antibiotic or herbicide.

After transformed plants are selected and grown to maturity, those plants showing a modified trait are identified. The modified trait can be any of those traits described above. Additionally, to confirm that the modified trait is due to changes in expression levels or activity of the polypeptide or polynucleotide of the invention can be determined by analyzing mRNA expression using Northern blots, RT-PCR or microarrays, or protein expression using immunoblots or Western blots or gel shift assays.

XVII. Integrated Systems—Sequence Identity

Additionally, the present invention may be an integrated system, computer or computer readable medium that comprises an instruction set for determining the identity of one or more sequences in a database. In addition, the instruction set can be used to generate or identify sequences that meet any specified criteria. Furthermore, the instruction set may be used to associate or link certain functional benefits, such improved characteristics, with one or more identified sequence.

For example, the instruction set can include, e.g., a sequence comparison or other alignment program, e.g., an available program such as, for example, the Wisconsin Package Version 10.0, such as BLAST, FASTA, PILEUP, FINDPATTERNS or the like (GCG, Madison, Wis.). Public sequence databases such as GenBank, EMBL, Swiss-Prot and PIR or private sequence databases such as PHYTOSEQ sequence database (Incyte Genomics, Palo Alto, Calif.) can be searched.

Alignment of sequences for comparison can be conducted by the local homology algorithm of Smith and Waterman (1981) *Adv. Appl. Math.* 2:482, by the homology alignment algorithm of Needleman and Wunsch (1970) *J. Mol. Biol.* 48:443-453, by the search for similarity method of Pearson and Lipman (1988) *Proc. Natl. Acad. Sci. U.S.A.* 85:2444-2448, by computerized implementations of these algorithms. After alignment, sequence comparisons between two (or more) polynucleotides or polypeptides are typically performed by comparing sequences of the two sequences over a comparison window to identify and compare local regions of sequence similarity. The comparison window can be a segment of at least about 20 contiguous positions, usually about 50 to about 200, more usually about 100 to about 150 contiguous positions. A description of the method is provided in Ausubel et al., supra.

A variety of methods for determining sequence relationships can be used, including manual alignment and computer assisted sequence alignment and analysis. This later approach is a preferred approach in the present invention, due to the increased throughput afforded by computer assisted methods. As noted above, a variety of computer programs for performing sequence alignment are available, or can be produced by one of skill.

One example algorithm that is suitable for determining percent sequence identity and sequence similarity is the BLAST algorithm, which is described in Altschul et al. *J. Mol. Biol.* 215:403-410 (1990). Software for performing BLAST analyses is publicly available, e.g., through the National Center for Biotechnology Information (see internet website at ncbi.nlm.nih.gov). This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al., supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, a cutoff of 100, M=5, N=−4, and a comparison of both strands. For amino acid sequences, the BLASTP program uses as defaults a wordlength (W) of 3, an expectation (E) of 10, and the BLOSUM62 scoring matrix (see Henikoff & Henikoff (1989) *Proc. Natl. Acad. Sci. USA* 89:10915). Unless otherwise indicated, "sequence identity" here refers to the % sequence identity generated from a tblastx using the NCBI version of the algorithm at the default settings using gapped alignments with the filter "off" (see, for example, internet website at ncbi.nlm.nih.gov).

In addition to calculating percent sequence identity, the BLAST algorithm also performs a statistical analysis of the similarity between two sequences (see, e.g., Karlin & Altschul (1993) *Proc. Natl. Acad. Sci. USA* 90:5873-5787). One measure of similarity provided by the BLAST algorithm is the smallest sum probability (P(N)), which provides an indication of the probability by which a match between two nucleotide or amino acid sequences would occur by chance. For example, a nucleic acid is considered similar to a reference sequence (and, therefore, in this context, homologous) if the smallest sum probability in a comparison of the test nucleic acid to the reference nucleic acid is less than about 0.1, or less than about 0.01, and or even less than about 0.001. An additional example of a useful sequence alignment algorithm is PILEUP. PILEUP creates a multiple sequence alignment from a group of related sequences using progressive, pairwise alignments. The program can align, e.g., up to 300 sequences of a maximum length of 5,000 letters.

The integrated system, or computer typically includes a user input interface allowing a user to selectively view one or more sequence records corresponding to the one or more character strings, as well as an instruction set which aligns the one or more character strings with each other or with an additional character string to identify one or more region of sequence similarity. The system may include a link of one or more character strings with a particular phenotype or gene function. Typically, the system includes a user readable output element that displays an alignment produced by the alignment instruction set.

The methods of this invention can be implemented in a localized or distributed computing environment. In a distributed environment, the methods may be implemented on a single computer comprising multiple processors or on a multiplicity of computers. The computers can be linked, e.g. through a common bus, but more preferably the computer(s) are nodes on a network. The network can be a generalized or a dedicated local or wide-area network and, in certain preferred embodiments, the computers may be components of an intra-net or an internet.

Thus, the invention provides methods for identifying a sequence similar or homologous to one or more polynucleotides as noted herein, or one or more target polypeptides encoded by the polynucleotides, or otherwise noted herein and may include linking or associating a given plant phenotype or gene function with a sequence. In the methods, a sequence database is provided (locally or across an inter or intra net) and a query is made against the sequence database using the relevant sequences herein and associated plant phenotypes or gene functions.

Any sequence herein can be entered into the database, before or after querying the database. This provides for both expansion of the database and, if done before the querying step, for insertion of control sequences into the database. The control sequences can be detected by the query to ensure the general integrity of both the database and the query. As noted, the query can be performed using a web browser based interface. For example, the database can be a centralized public database such as those noted herein, and the querying can be done from a remote terminal or computer across an internet or intranet.

EXAMPLES

The following examples are intended to illustrate but not limit the present invention. The complete descriptions of the traits associated with each polynucleotide of the invention is fully disclosed in Table 5 and Table 6.

Example I

Full Length Gene Identification and Cloning

Putative transcription factor sequences (genomic or ESTs) related to known transcription factors were identified in the *Arabidopsis thaliana* GenBank database using the tblastn sequence analysis program using default parameters and a P-value cutoff threshold of −4 or −5 or lower, depending on the length of the query sequence. Putative transcription factor sequence hits were then screened to identify those containing particular sequence strings. If the sequence hits contained such sequence strings, the sequences were confirmed as transcription factors.

Alternatively, *Arabidopsis thaliana* cDNA libraries derived from different tissues or treatments, or genomic libraries were screened to identify novel members of a transcription family using a low stringency hybridization approach. Probes were synthesized using gene specific primers in a standard PCR reaction (annealing temperature 60° C.) and labeled with $^{32}$P dCTP using the High Prime DNA Labeling Kit (Boehringer Mannheim). Purified radiolabelled probes were added to filters immersed in Church hybridization medium (0.5 M NaPO$_4$ pH 7.0, 7% SDS, 1% w/v bovine serum albumin) and hybridized overnight at 60° C. with shaking. Filters were washed two times for 45 to 60 minutes with 1×SCC, 1% SDS at 60° C.

To identify additional sequence 5' or 3' of a partial cDNA sequence in a cDNA library, 5' and 3' rapid amplification of cDNA ends (RACE) was performed using the Marathon™ cDNA amplification kit (Clontech, Palo Alto, Calif.). Generally, the method entailed first isolating poly(A) mRNA, performing first and second strand cDNA synthesis to generate double stranded cDNA, blunting cDNA ends, followed by ligation of the Marathon™ Adaptor to the cDNA to form a library of adaptor-ligated ds cDNA.

Gene-specific primers were designed to be used along with adaptor specific primers for both 5' and 3' RACE reactions. Nested primers, rather than single primers, were used to increase PCR specificity. Using 5' and 3' RACE reactions, 5' and 3' RACE fragments were obtained, sequenced and cloned. The process can be repeated until 5' and 3' ends of the full-length gene were identified. Then the full-length cDNA was generated by PCR using primers specific to 5' and 3' ends of the gene by end-to-end PCR.

Example II

Construction of Expression Vectors

The sequence was amplified from a genomic or cDNA library using primers specific to sequences upstream and downstream of the coding region. the expression vector was pMEN20 or pMEN65, which are both derived from pMON316 (Sanders et al, (1987) *Nucleic Acids Research* 15:1543-1558) and contain the cauliflower mosaic (MV) 35S promoter to express transgenes. To clone the sequence into the vector, both pmen20 and the amplified DNA fragment were digested separately with Sali and Noti restriction enzymes at 37° C. for 2 hours. The digestion products were subject to electrophoresis in a 0.8% agarose gel and visualized by ethidium bromide staining. The DNA fragments containing the sequence and the linearized plasmid were excised and purified by using a Qiaquick gel extraction kit (Qiagen, Valencia Calif.). The fragments of interest were ligated at a ratio of 3:1 (vector to insert). Ligation reactions using t4 DNA ligase (New England Biolabs, Beverly, Mass.) were carried out at 16° c. for 16 hours. The ligated DNAs were transformed into competent cells of the *E. coli* strain DH5alpha by using the heat shock method. The transformations were plated on LB plates containing 50 mg/l kanamycin (Sigma, St. Louis, Mo.). Individual colonies were grown overnight in five milliliters of LB broth containing 50 mg/l kanamycin at 37° c. Plasmid DNA was purified by using Qiaquick Mini Prep kits (Qiagen).

Example III

Transformation of *Agrobacterium* with the Expression Vector

After the plasmid vector containing the gene was constructed, the vector was used to transform *Agrobacterium tumefaciens* cells expressing the gene products. The stock of *Agrobacterium tumefaciens* cells for transformation were made as described by Nagel et al. (1990) *FEMS Microbiol Letts.* 67: 325-328. *Agrobacterium* strain ABI was grown in 250 ml LB medium (Sigma) overnight at 28° C. with shaking until an absorbance ($A_{600}$) of 0.5-1.0 was reached. Cells were harvested by centrifugation at 4,000×g for 15 min at 4° C. Cells were then resuspended in 250 µl chilled buffer (1 mM HEPES, pH adjusted to 7.0 with KOH). Cells were centrifuged again as described above and resuspended in 125 µl chilled buffer. Cells were then centrifuged and resuspended two more times in the same HEPES buffer as described above at a volume of 100 µl and 750 µl, respectively. Resuspended cells were then distributed into 40 µl aliquots, quickly frozen in liquid nitrogen, and stored at −80° C.

*Agrobacterium* cells were transformed with plasmids prepared as described above following the protocol described by Nagel et al. For each DNA construct to be transformed, 50-100 ng DNA (generally resuspended in 10 mM Tris-HCl, 1 mM EDTA, pH 8.0) was mixed with 40 µl of *Agrobacterium* cells. The DNA/cell mixture was then transferred to a chilled cuvette with a 2 mm electrode gap and subject to a 2.5 kV charge dissipated at 25 µF and 200 µF using a Gene Pulser II apparatus (Bio-Rad, Hercules, Calif.). After electroporation, cells were immediately resuspended in 1.0 ml LB and allowed to recover without antibiotic selection for 2-4 hours at 28° C. in a shaking incubator. After recovery, cells were plated onto selective medium of LB broth containing 100 µg/ml spectinomycin (Sigma) and incubated for 24-48 hours at 28° C. Single colonies were then picked and inoculated in fresh medium. The presence of the plasmid construct was verified by PCR amplification and sequence analysis.

Example IV

Transformation of *Arabidopsis* Plants with *Agrobacterium tumefaciens* with Expression Vector After transformation of *Agrobacterium tumefaciens* with plasmid vectors containing the gene, single *Agrobacterium* colonies were identified, propagated, and used to transform *Arabidopsis* plants. Briefly, 500 ml cultures of LB medium containing 50 mg/l kanamycin were inoculated with the colonies and grown at 28° C. with shaking for 2 days until an optical absorbance at 600 nm wavelength over 1 cm ($A_{600}$) of >2.0 is reached. Cells were then harvested by centrifugation at 4,000×g for 10 min, and resuspended in infiltration medium (½× Murashige and Skoog salts (Sigma), 1× Gamborg's B-5 vitamins (Sigma), 5.0% (w/v) sucrose (Sigma), 0.044 µM benzylamino purine (Sigma), 200 µl/l Silwet L-77 (Lehle Seeds) until an $A_{600}$ of 0.8 was reached.

Prior to transformation, *Arabidopsis thaliana* seeds (ecotype Columbia) were sown at a density of ~10 plants per 4" pot onto Pro-Mix BX potting medium (Hummert International) covered with fiberglass mesh (18 mm×16 mm) Plants were grown under continuous illumination (50-75 µE/m²/sec) at 22-23° C. with 65-70% relative humidity. After about 4 weeks, primary inflorescence stems (bolts) are cut off to encourage growth of multiple secondary bolts. After flowering of the mature secondary bolts, plants were prepared for transformation by removal of all siliques and opened flowers.

The pots were then immersed upside down in the mixture of *Agrobacterium* infiltration medium as described above for 30 sec, and placed on their sides to allow draining into a 1'×2' flat surface covered with plastic wrap. After 24 h, the plastic wrap was removed and pots are turned upright. The immersion procedure was repeated one week later, for a total of two immersions per pot. Seeds were then collected from each transformation pot and analyzed following the protocol described below.

Example V

Identification of *Arabidopsis* Primary Transformants

Seeds collected from the transformation pots were sterilized essentially as follows. Seeds were dispersed into in a solution containing 0.1% (v/v) Triton X-100 (Sigma) and sterile $H_2O$ and washed by shaking the suspension for 20 min The wash solution was then drained and replaced with fresh wash solution to wash the seeds for 20 min with shaking. After removal of the second wash solution, a solution containing 0.1% (v/v) Triton X-100 and 70% ethanol (Equistar) was added to the seeds and the suspension was shaken for 5 min. After removal of the ethanol/detergent solution, a solution containing 0.1% (v/v) Triton X-100 and 30% (v/v) bleach (Clorox) was added to the seeds, and the suspension was shaken for 10 min. After removal of the bleach/detergent solution, seeds were then washed five times in sterile distilled $H_2O$. The seeds were stored in the last wash water at 4° C. for 2 days in the dark before being plated onto antibiotic selection medium (1× Murashige and Skoog salts (pH adjusted to 5.7 with 1M KOH), 1× Gamborg's B-5 vitamins, 0.9% phytagar (Life Technologies), and 50 mg/l kanamycin). Seeds were germinated under continuous illumination (50-75 µE/m²/sec) at 22-23° C. After 7-10 days of growth under these conditions, kanamycin resistant primary transformants ($T_1$ generation) were visible and obtained. These seedlings were transferred first to fresh selection plates where the seedlings continued to grow for 3-5 more days, and then to soil (Pro-Mix BX potting medium).

Primary transformants were crossed and progeny seeds ($T_2$) collected; kanamycin resistant seedlings were selected and analyzed. The expression levels of the recombinant polynucleotides in the transformants varies from about a 5% expression level increase to a least a 100% expression level increase. Similar observations are made with respect to polypeptide level expression.

Example VI

Identification of *Arabidopsis* Plants with Transcription Factor Gene Knockouts

The screening of insertion mutagenized *Arabidopsis* collections for null mutants in a known target gene was essentially as described in Krysan et al (1999) *Plant Cell* 11:2283-2290. Briefly, gene-specific primers, nested by 5-250 base pairs to each other, were designed from the 5' and 3' regions of a known target gene. Similarly, nested sets of primers were also created specific to each of the T-DNA or transposon ends (the "right" and "left" borders). All possible combinations of gene specific and T-DNA/transposon primers were used to detect by PCR an insertion event within or close to the target gene. The amplified DNA fragments were then sequenced which allows the precise determination of the T-DNA/transposon insertion point relative to the target gene. Insertion events within the coding or intervening sequence of the genes were deconvoluted from a pool comprising a plurality of insertion events to a single unique mutant plant for functional characterization. The method is described in more detail in Yu and Adam, U.S. application Ser. No. 09/177,733 filed Oct. 23, 1998.

Example VII

Identification of Modified Phenotypes in Overexpression or Gene Knockout Plants

Experiments were performed to identify those transformants or knockouts that exhibited modified biochemical characteristics. Among the biochemicals that were assayed were insoluble sugars, such as arabinose, fucose, galactose, mannose, rhamnose or xylose or the like; prenyl lipids, such as lutein, beta-carotene, xanthophyll-1, xanthophyll-2, chlorophylls A or B, or alpha-, delta- or gamma-tocopherol or the like; fatty acids, such as 16:0 (palmitic acid), 16:1 (palmitoleic acid), 18:0 (stearic acid), 18:1 (oleic acid), 18:2 (linoleic acid), 20:0, 18:3 (linolenic acid), 20:1 (eicosenoic acid), 20:2, 22:1 (erucic acid) or the like; waxes, such as by altering the levels of C29, C31, or C33 alkanes; sterols, such as brassicasterol, campesterol, stigmasterol, sitosterol or stigmastanol or the like, glucosinolates, protein or oil levels.

Fatty acids were measured using two methods depending on whether the tissue was from leaves or seeds. For leaves, lipids were extracted and esterified with hot methanolic $H_2SO_4$ and partitioned into hexane from methanolic brine. For seed fatty acids, seeds were pulverized and extracted in methanol:heptane:toluene:2,2-dimethoxypropane:$H_2SO_4$ (39:34:20:5:2) for 90 minutes at 80° C. After cooling to room temperature the upper phase, containing the seed fatty acid esters, was subjected to GC analysis. Fatty acid esters from both seed and leaf tissues were analyzed with a Supelco SP-2330 column.

Glucosinolates were purified from seeds or leaves by first heating the tissue at 95° C. for 10 minutes. Preheated ethanol:water (50:50) is and after heating at 95° C. for a further 10 minutes, the extraction solvent is applied to a DEAE Sephadex column which had been previously equilibrated with 0.5 M pyridine acetate. Desulfoglucosinolates were eluted with 300 µl water and analyzed by reverse phase HPLC monitoring at 226 nm.

For wax alkanes, samples were extracted using an identical method as fatty acids and extracts were analyzed on a HP 5890 GC coupled with a 5973 MSD. Samples were chromatographically isolated on a J&W DB35 mass spectrometer (J&W Scientific).

To measure prenyl lipids levels, seeds or leaves were pulverized with 1 to 2% pyrogallol as an antioxidant. For seeds, extracted samples were filtered and a portion removed for tocopherol and carotenoid/chlorophyll analysis by HPLC. The remaining material was saponified for sterol determination. For leaves, an aliquot was removed and diluted with methanol and chlorophyll A, chlorophyll B, and total carotenoids measured by spectrophotometry by determining optical absorbance at 665.2 nm, 652.5 nm, and 470 nm. An aliquot was removed for tocopherol and carotenoid/chlorophyll composition by HPLC using a Waters µBondapak C18 column (4.6 mm×150 mm) The remaining methanolic solution was saponified with 10% KOH at 80° C. for one hour. The samples were cooled and diluted with a mixture of methanol and water. A solution of 2% methylene chloride in hexane was mixed in and the samples were centrifuged. The aqueous methanol phase was again re-extracted 2% methylene chloride in hexane and, after centrifugation, the two upper phases were combined and evaporated. 2% methylene chloride in hexane was added to the tubes and the samples were then extracted with one ml of water. The upper phase was removed, dried, and resuspended in 400 µl of 2% methylene chloride in hexane and analyzed by gas chromatography using a 50 m DB-5 ms (0.25 mm ID, 0.25 µm phase, J&W Scientific).

Insoluble sugar levels were measured by the method essentially described by Reiter et al., (1999) *Plant Journal* 12:335-345. This method analyzes the neutral sugar composition of cell wall polymers found in *Arabidopsis* leaves. Soluble sugars were separated from sugar polymers by extracting leaves with hot 70% ethanol. The remaining residue containing the insoluble polysaccharides was then acid hydrolyzed with allose added as an internal standard. Sugar monomers generated by the hydrolysis were then reduced to the corresponding alditols by treatment with $NaBH_4$, then were acetylated to generate the volatile alditol acetates which were then analyzed by GC-FID. Identity of the peaks was determined by comparing the retention times of known sugars converted to the corresponding alditol acetates with the retention times of peaks from wild-type plant extracts. Alditol acetates were analyzed on a Supelco SP-2330 capillary column (30 m×250 um×0.2 um) using a temperature program beginning at 180° C. for 2 minutes followed by an increase to 220° C. in 4 minutes. After holding at 220° C. for 10 minutes, the oven temperature is increased to 240° C. in 2 minutes and held at this temperature for 10 minutes and brought back to room temperature.

To identify plants with alterations in total seed oil or protein content, 150 mg of seeds from T2 progeny plants were subjected to analysis by Near Infrared Reflectance Spectroscopy (NIRS) using a Foss NirSystems Model 6500 with a spinning cup transport system. NIRS is a non-destructive analytical method used to determine seed oil and protein composition. Infrared is the region of the electromagnetic spectrum located after the visible region in the direction of longer wavelengths. 'Near infrared' owns its name for being the infrared region near to the visible region of the electromagnetic spectrum. For practical purposes, near infrared comprises wavelengths between 800 and 2500 nm. NIRS is applied to organic compounds rich in O—H bonds (such as moisture, carbohydrates, and fats), C—H bonds (such as organic compounds and petroleum derivatives), and N—H bonds (such as proteins and amino acids). The NIRS analytical instruments operate by statistically correlating NIRS signals at several wavelengths with the characteristic or property intended to be measured. All biological substances contain thousands of C—H, O—H, and N—H bonds. Therefore, the exposure to near infrared radiation of a biological sample, such as a seed, results in a complex spectrum which contains qualitative and quantitative information about the physical and chemical composition of that sample.

The numerical value of a specific analyte in the sample, such as protein content or oil content, is mediated by a calibration approach known as chemometrics. Chemometrics applies statistical methods such as multiple linear regression (MLR), partial least squares (PLS), and principle component analysis (PCA) to the spectral data and correlates them with a physical property or other factor, that property or factor is directly determined rather than the analyte concentration itself. The method first provides "wet chemistry" data of the samples required to develop the calibration.

Calibration for *Arabidopsis* seed oil composition was performed using accelerated solvent extraction using 1 g seed sample size and was validated against certified canola seed. A similar wet chemistry approach was performed for seed protein composition calibration.

Data obtained from NIRS analysis was analyzed statistically using a nearest-neighbor (N—N) analysis. The N—N analysis allows removal of within-block spatial variability in a fairly flexible fashion which does not require prior knowledge of the pattern of variability in the chamber. Ideally, all hybrids are grown under identical experimental conditions within a block (rep). In reality, even in many block designs, significant within-block variability exists. Nearest-neighbor procedures are based on assumption that environmental effect of a plot is closely related to that of its neighbors. Nearest-neighbor methods use information from adjacent plots to adjust for within-block heterogeneity and so provide more precise estimates of treatment means and differences. If there is within-plot heterogeneity on a spatial scale that is larger than a single plot and smaller than the entire block, then yields from adjacent plots will be positively correlated. Information from neighboring plots can be used to reduce or remove the unwanted effect of the spatial heterogeneity, and hence improve the estimate of the treatment effect. Data from neighboring plots can also be used to reduce the influence of competition between adjacent plots. The Papadakis N—N analysis can be used with designs to remove within-block variability that would not be removed with the standard split plot analysis (Papadakis, 1973, Inst. d'Amelior. Plantes Thessaloniki (Greece) Bull. Scientif., No. 23; Papadakis, 1984, Proc. Acad. Athens, 59, 326-342).

Experiments were performed to identify those transformants or knockouts that exhibited an improved pathogen tolerance. For such studies, the transformants were exposed to biotropic fungal pathogens, such as *Erysiphe orontii*, and necrotropic fungal pathogens, such as *Fusarium oxysporum*. *Fusarium oxysporum* isolates cause vascular wilts and damping off of various annual vegetables, perennials and weeds (Mauch-Mani and Slusarenko (1994) *Molecular Plant-Microbe Interactions* 7: 378-383). For *Fusarium oxysporum* experiments, plants grown on Petri dishes were sprayed with a fresh spore suspension of *F. oxysporum*. The spore suspension was prepared as follows: A plug of fungal hyphae from a plate culture was placed on a fresh potato dextrose agar plate and allowed to spread for one week. 5 ml sterile water was then added to the plate, swirled, and pipetted into 50 ml Armstrong *Fusarium* medium. Spores were grown overnight in *Fusarium* medium and then sprayed onto plants using a Preval paint sprayer. Plant tissue was harvested and frozen in liquid nitrogen 48 hours post infection.

*Erysiphe orontii* is a causal agent of powdery mildew. For *Erysiphe orontii* experiments, plants were grown approximately 4 weeks in a greenhouse under 12 hour light (20° C., ~30% relative humidity (rh)). Individual leaves were infected with *E. orontii* spores from infected plants using a camel's hair brush, and the plants were transferred to a Percival growth chamber (20° C., 80% rh.). Plant tissue was harvested and frozen in liquid nitrogen 7 days post infection.

*Botrytis cinerea* is a necrotrophic pathogen. *Botrytis cinerea* was grown on potato dextrose agar in the light. A spore culture was made by spreading 10 ml of sterile water on the fungus plate, swirling and transferring spores to 10 ml of sterile water. The spore inoculum (approx. 105 spores/ml) was used to spray 10 day-old seedlings grown under sterile conditions on MS (minus sucrose) media. Symptoms were evaluated every day up to approximately 1 week.

Infection with bacterial pathogens *Pseudomonas syringae* pv maculicola (Psm) strain 4326 and pv maculicola strain 4326 was performed by hand inoculation at two doses. Two inoculation doses allows the differentiation between plants with enhanced susceptibility and plants with enhanced resistance to the pathogen. Plants were grown for 3 weeks in the greenhouse, then transferred to the growth chamber for the remainder of their growth. Psm ES4326 was hand inoculated with 1 ml syringe on 3 fully-expanded leaves per plant (4½ wk old), using at least 9 plants per overexpressing line at two inoculation doses, OD=0.005 and OD=0.0005. Disease scoring occurred at day 3 post-inoculation with pictures of the plants and leaves taken in parallel.

In some instances, expression patterns of the pathogen-induced genes (such as defense genes) was monitored by microarray experiments. cDNAs were generated by PCR and resuspended at a final concentration of ~100 ng/µl in 3×SSC or 150 mM Na-phosphate (Eisen and Brown (1999) *Methods Enzymol.* 303:179-205). The cDNAs were spotted on microscope glass slides coated with polylysine. The prepared cDNAs were aliquoted into 384 well plates and spotted on the slides using an x-y-z gantry (OmniGrid) purchased from GeneMachines (Menlo Park, Calif.) outfitted with quill type pins purchased from Telechem International (Sunnyvale, Calif.). After spotting, the arrays were cured for a minimum of one week at room temperature, rehydrated and blocked following the protocol recommended by Eisen and Brown (1999; supra).

Sample total RNA (10 µg) samples were labeled using fluorescent Cy3 and Cy5 dyes. Labeled samples were resuspended in 4×SSC/0.03% SDS/4 µg salmon sperm DNA/2 µg tRNA/50 mM Na-pyrophosphate, heated for 95° C. for 2.5 minutes, spun down and placed on the array. The array was then covered with a glass coverslip and placed in a sealed chamber. The chamber was then kept in a water bath at 62° C. overnight. The arrays were washed as described in Eisen and Brown (1999) and scanned on a General Scanning 3000 laser scanner. The resulting files are subsequently quantified using Imagene, a software purchased from BioDiscovery (Los Angeles, Calif.).

Experiments were performed to identify those transformants or knockouts that exhibited an improved environmental stress tolerance. For such studies, the transformants were exposed to a variety of environmental stresses. Plants were exposed to chilling stress (6 hour exposure to 4-8° C.), heat stress (6 hour exposure to 32-37° C.), high salt stress (6 hour exposure to 200 mM NaCl), drought stress (168 hours after removing water from trays), osmotic stress (6 hour exposure to 3 M mannitol), or nutrient limitation (nitrogen, phosphate, and potassium) (Nitrogen: all components of MS medium remained constant except N was reduced to 20 mg/l of $NH_4NO_3$, or Phosphate: All components of MS medium except $KH_2PO_4$, which was replaced by $K_2SO_4$, Potassium: All components of MS medium except removal of $KNO_3$ and $KH_2PO_4$, which were replaced by $NaH_4PO_4$).

Experiments were performed to identify those transformants or knockouts that exhibited a modified structure and development characteristics. For such studies, the transformants were observed by eye to identify novel structural or developmental characteristics associated with the ectopic expression of the polynucleotides or polypeptides of the invention.

Experiments were performed to identify those transformants or knockouts that exhibited modified sugar-sensing. For such studies, seeds from transformants were germinated on media containing 5% glucose or 9.4% sucrose which normally partially restrict hypocotyl elongation. Plants with altered sugar sensing may have either longer or shorter hypocotyls than normal plants when grown on this media. Additionally, other plant traits may be varied such as root mass.

Flowering time was measured by the number of rosette leaves present when a visible inflorescence of approximately 3 cm is apparent Rosette and total leaf number on the progeny stem are tightly correlated with the timing of flowering (Koornneef et al (1991) *Mol. Gen. Genet* 229:57-66. The vernalization response was measured. For vernalization treatments, seeds were sown to MS agar plates, sealed with micropore tape, and placed in a 4° C. cold room with low light levels for 6-8 weeks. The plates were then transferred to the growth rooms alongside plates containing freshly sown non-vernalized controls. Rosette leaves were counted when a visible inflorescence of approximately 3 cm was apparent.

Modified phenotypes observed for particular overexpressor or knockout plants are provided in Table 5. For a particular overexpressor that shows a less beneficial characteristic, it may be more useful to select a plant with a decreased expression of the particular transcription factor. For a particular knockout that shows a less beneficial characteristic, it may be more useful to select a plant with an increased expression of the particular transcription factor.

The sequences of the Sequence Listing or those in Tables 4, Table 5 or those disclosed here can be used to prepare transgenic plants and plants with altered traits. The specific transgenic plants listed below are produced from the sequences of the Sequence Listing, as noted. Table 5 provides exemplary polynucleotide and polypeptide sequences of the invention. Table 5 includes, from left to right for each sequence: the first column shows the polynucleotide SEQ ID NO; the second column shows the Mendel Gene ID No., GID; the third column shows the trait(s) resulting from the knock out or overexpression of the polynucleotide in the transgenic plant; the fourth column shows the category of the trait; the fifth column shows the transcription factor family to which the polynucleotide belongs; the sixth column ("Comment"), includes specific effects and utilities conferred by the polynucleotide of the first column; the seventh column shows the SEQ ID NO of the polypeptide encoded by the polynucleotide; and the eighth column shows the amino acid residue positions of the conserved domain in amino acid (AA) co-ordinates.

Seed of plants overexpressing sequences G265 (SEQ ID NOs:871 and 872), G715 (SEQ ID NOs:925 and 926), G1471 (SEQ ID NOs:311 and 312), G1793 (SEQ ID NOs:365 and 366), G1838 (SEQ ID NOs:381 and 382), G1902 (SEQ ID NOs:405 and 406), G286 (SEQ ID NOs:877 and 878), G2138 (SEQ ID NOs:865 and 866) and G2830 (SEQ ID NOs:875 and 876) was subjected to NIR analysis and a significant increase in seed oil content compared with seed from control plants was identified.

G192: G192 (SEQ ID NO: 859) was expressed in all plant tissues and under all conditions examined Its expression was slightly induced upon infection by *Fusarium*. G192 was analyzed using transgenic plants in which this gene was expressed under the control of the 35S promoter. G192 overexpressors were late flowering under 12 hour light and had more leaves than control plants. This phenotype was manifested in the three T2 lines analyzed. Results of one experiment suggest that G192 overexpressor was more susceptible to infection with a moderate dose of the fungal pathogen *Erysiphe orontii*. The decrease in seed oil observed for one line was replicated in an independent experiment. G192 overexpression delayed flowering. A wide variety of applications exist for systems that either lengthen or shorten the time to flowering, or for systems of inducible flowering time control. In particular, in species where the vegetative parts of the plants constitute the crop and the reproductive tissues are discarded, it will be advantageous to delay or prevent flowering. Extending vegetative development can bring about large increases in yields. G192 can be used to manipulate the defense response in order to generate pathogen-resistant plants. G192 can be used to manipulate seed oil content, which can be of nutritional value.

Closely Related Genes from Other Species

G192 had some similarity within the conserved WRKY domain to non-Arabidopsis plant proteins.

G1946: G1946 (SEQ ID NO: 801) was studied using transgenic plants in which the gene was expressed under the control of the 35S promoter. Overexpression of G1946 resulted in accelerated flowering, with 35S::G1946 transformants producing flower buds up to a week earlier than wild-type controls (24-hour light conditions). These effects were seen in 12/20 primary transformants and in two independent plantings of each of the three T2 lines. Unlike many early flowering *Arabidopsis* transgenic lines, which are dwarfed, 35S::G1946 transformants often reached full-size at maturity, and produced large quantities of seeds, although the plants were slightly pale in coloration and had slightly flat leaves compared to wild-type. In addition, 35S::G1946 plants showed an altered response to phosphate deprivation. Seedlings of G1946 overexpressor plants showed more secondary root growth on phosphate-free media, when compared to wild-type control. In a repeat experiment, all three lines showed the phenotype. Overexpression of G1946 in *Arabidopsis* also resulted in an increase in seed glucosinolate M39501 in T2 lines 1 and 3. An increase in seed oil and a decrease in seed protein was also observed in these two lines. G1946 was ubiquitously expressed, and does not appear to be significantly induced or repressed by any of the biotic and abiotic stress conditions tested at this time, with the exception of cold, which repressed G1946 expression. G1946 can be used to modify flowering time, as well as to improve the plant's performance in conditions of limited phosphate, and to alter seed oil, protein, and glucosinolate composition.

Closely Related Genes from Other Species

A comparison of the amino acid sequence of G1946 with sequences available from GenBank showed strong similarity with plant HSFs of several species (*Lycopersicon peruvianum, Medicago truncatula, Lycopersicon esculentum, Glycine max, Solanum tuberosum, Oryza sativa* and *Hordeum vulgare* subsp. *vulgare*).

G375: The sequence of G375 (SEQ ID NO:239) was experimentally determined and G375 was analyzed using transgenic plants in which G375 was expressed under the control of the 35S promoter. Overexpression of G375 produced marked effects on leaf development. At early stages of growth, 35S::G375 seedlings developed narrow, upward pointing leaves with long petioles (possibly indicating a disruption in circadian-clock controlled processes or nyctinastic movements). Additionally, some seedlings were noted to have elongated hypocotyls, and some were rather small compared to wild-type controls. Comparable phenotypes were obtained by overexpression of an AP2 family gene, G2113 (SEQ ID NO: 85). Following the switch to flowering, 35S:: G375 plants showed reduced fertility, which possibly arose from a failure of stamens to fully elongate. One of the three T2 lines, (#41) was later flowering than wild-type controls, and also developed large numbers of small secondary rosette leaves in the axils of the primary rosette. Although these effects were not noted in the other two lines, the phenotypes obtained in line 41 were somewhat similar to those produced by overexpression of another Z-dof gene, G736 (SEQ ID NO: 211). G375 was expressed in all tissues, although at different levels. It was expressed at low levels in the root and germinating seed, and expressed at high levels in the embryo. The effects of G375 on leaf architecture are of potential interest to the ornamental horticulture industry.

Closely Related Genes from Other Species

G375 showed some homology to non-Arabidopsis plant proteins within the conserved D of domain.

G1255: The sequence of G1255 (SEQ ID NO: 273) was experimentally determined and G1255 was analyzed using transgenic plants in which G1255 was expressed under the control of the 35S promoter. Plants overexpressing G1255 had alterations in leaf architecture, a reduction in apical dominance, an increase in seed size, and showed more disease symptoms following inoculation with a low dose of the fungal pathogen *Botrytis cinerea*. G1255 was constitutively expressed and not significantly induced by any conditions tested. On the basis of the phenotypes produced by overexpression of G1255, G1255 can be used to manipulate the plant's defense response to produce pathogen resistance, alter plant architecture, or alter seed size.

Closely Related Genes from Other Species

G1255 showed strong homology to a putative rice zing finger protein represented by sequence AC087181_3. Sequence identity between these two protein extended beyond the conserved domain, and therefore, these genes can be orthologs.

G865: The complete cDNA sequence of G865 (SEQ ID NO: 557) was determined. G865 was ubiquitously expressed in *Arabidopsis* tissues. G865 was analyzed using transgenic plants in which G865 was expressed under the control of the 35S promoter. Plants overexpressing G865 were early flowering, with numerous secondary inflorescence meristems giving them a bushy appearance. G865 overexpressors were more susceptible to infection with a moderate dose of the fungal pathogens *Erysiphe orontii* and *Botrytis cinerea*. In addition, seeds from G865 overexpressing plants showed a trend of increased protein and reduced oil content, although the observed changes were not beyond the criteria used for judging significance except in one line. G865 can be used to control flowering time. G865 can be used to manipulate the defense response in order to generate pathogen-resistant plants. G865 can be used to alter seed oil and protein content of a plant.

Closely Related Genes from Other Species

G865 and other non-Arabidopsis AP2/EREBP proteins were similar within the conserved AP2 domain.

G2509: G2509 (SEQ ID NO: 23) was studied using transgenic plants in which the gene was expressed under the control of the 35S promoter. Overexpression of G2509 caused multiple alterations in plant growth and development, most notably, altered branching patterns, and a reduction in apical dominance, giving the plants a shorter, more bushy stature than wild type. Twenty 35S::G2509 primary transformants were examined; at early stages of rosette development, these plants displayed a wild-type phenotype. However, at the switch to flowering, almost all T1 lines showed a marked loss of apical dominance and large numbers of secondary shoots developed from axils of primary rosette leaves. In the most extreme cases, the shoots had very short internodes, giving the inflorescence a very bushy appearance. Such shoots were often very thin and flowers were relatively small and poorly fertile. At later stages, many plants appeared very small and had a low seed yield compared to wild type. In addition to the effects on branching, a substantial number of 35S::G2509 primary transformants also flowered early and had buds visible several days prior to wild type. Similar effects on inflorescence development were noted in each of three T2 populations examined. The branching and plant architecture phenotypes observed in 35S::G2509 lines resemble phenotypes observed for three other AP2/EREBP genes: G865 (SEQ ID NO: 557), G1411 (SEQ ID NO: 3), and G1794 (SEQ ID NO: 13). G2509, G865, and G1411 form a small Glade within the large AP2/EREBP family, and G1794, although not belonging to the Glade, is one of the AP2/EREBP genes closest to it in the phylogenetic tree. It is thus likely that all these genes share a related function, such as affecting hormone balance. Overexpression of G2509 in *Arabidopsis* resulted in an increase in alpha-tocopherol in seeds in T2 lines 5 and 11. G2509 was ubiquitously expressed in *Arabidopsis* plant tissue. G2509 expression levels were altered by a variety of environmental or physiological conditions. G2509 can be used to manipulate plant architecture and development. G2509 can be used to alter tocopherol composition. Tocopherols have anti-oxidant and vitamin E activity. G2509 can be useful in altering flowering time. A wide variety of applications exist for systems that either lengthen or shorten the time to flowering.

Closely Related Genes from Other Species

G2509 showed some sequence similarity with known genes from other plant species within the conserved AP2/EREBP domain.

G2347: G2347 (SEQ ID NO: 1119) was analyzed using transgenic plants in which G2347 was expressed under the control of the 35S promoter. Overexpression of G2347 markedly reduced the time to flowering in *Arabidopsis*. This phenotype was apparent in the majority of primary transformants and in all plants from two out of the three T2 lines examined Under continuous light conditions, 35S::G2347 plants formed flower buds up a week earlier than wild type. Many of the plants were rather small and spindly compared to controls. To demonstrate that overexpression of G2347 could induce flowering under less inductive photoperiods, two T2 lines were re-grown in 12 hour conditions; again, all plants from both lines bolted early, with some initiating flower buds up to two weeks sooner than wild-type. As determined by RT-PCR, G2347 was highly expressed in rosette leaves and flowers, and to much lower levels in embryos and siliques. No expression of G2347 was detected in the other tissues tested. G2347 expression was repressed by cold, and by auxin treatments and by infection by *Erysiphe*. G2347 is also highly similar to the *Arabidopsis* protein G2010 (SEQ ID NO: 1121). The level of homology between these two proteins suggested they could have similar, overlapping, or redundant functions in *Arabidopsis*. In support of this hypothesis, overexpression of both G2010 and G2347 resulted in early flowering phenotypes in transgenic plants.

Closely Related Genes from Other Species

The closest relative to G2347 is the Antirrhinum protein, SBP2 (CAA63061). The similarity between these two proteins is extensive enough to suggest they might have similar functions in a plant.

G988: G988 (SEQ ID NO: 43) was analyzed using transgenic plants in which G988 was expressed under the control of the 35S promoter. Plants overexpressing G988 had multiple morphological phenotypes. The transgenic plants were generally smaller than wild-type plants, had altered leaf, inflorescence and flower development, altered plant architecture, and altered vasculature. In one transgenic line overexpressing G988 (line 23), an increase in the seed glucosinolate M39489 was observed. The phenotype of plants overexpressing G988 was wild-type in all other assays performed. In wild-type plants, G988 was expressed primarily in flower and silique tissue, but was also present at detectable levels in all other tissues tested. Expression of G988 was induced in response to heat treatment, and repressed in response to infection with *Erysiphe*. Based on the observed morphological phenotypes of the transgenic plants, G988 can be used to create plants with larger flowers. This can have value in the ornamental horticulture industry. The reduction in the formation of lateral branches suggests that G988 can have utility on the forestry industry. The *Arabidopsis* plants overexpressing G988 also had reduced fertility. This could actually be a desirable trait in some instances, as it can be exploited to prevent or minimize the escape of GMO (genetically modified organism) pollen into the environment.

Closely Related Genes from Other Species

The amino acid sequence for the *Capsella* rubella hypothetical protein represented by GenBank accession number CRU303349 was significantly identical to G988 outside of the SCR conserved domains. The *Capsella* rubella hypothetical protein is 90% identical to G988 over a stretch of roughly 450 amino acids. Therefore, it is likely that the *Capsella* rubella gene is an ortholog of G988.

G2346: G2346 (SEQ ID NO: 459) was analyzed using transgenic plants in which the gene was expressed under the control of the 35S promoter. 35S::G2346 seedlings from all three T2 populations had slightly larger cotyledons and appeared somewhat more advanced than controls. This indicated that the seedlings developed more rapidly that the control plants. At later stages, however, G2346 overexpressing plants showed no consistent differences from control plants. The phenotype of these transgenic plants was wild-type in all other assays performed. According to RT-PCR analysis, G2346 is expressed ubiquitously.

Closely Related Genes from Other Species

G2346 shows some sequence similarity with known genes from other plant species within the conserved SBP domain.

G1354: The complete sequence of G1354 (SEQ ID NO: 285) was determined G1354 was analyzed using transgenic plants in which G1354 was expressed under the control of the 35S promoter. Overexpression of G1354 produced highly deleterious effects on growth and development. Only three 35S::G1354 T1 plants were obtained; all were extremely tiny and slow developing. After three weeks of growth, each of the plants comprised a completely disorganized mass of leaves and root that had no clear axis of growth. Since these individuals would not have survived transplantation to soil, they were harvested for RT-PCR analysis; all three plants showed moderate levels of G1354 overexpression compared to whole wild-type seedlings of an equivalent size. Only a very small number of transformants were obtained from two selection attempts on separate batches of T0 seed. Usually between 15 and 120 transformants are obtained from each aliquot of 300 mg T0 seed from wild-type plants. The low transformation frequency obtained in this experiment suggests that high levels of G1354 overexpression might have completely lethal effects and prevent transformed seeds from germinating. As determined by RT-PCR, G1354 was uniformly expressed in all tissues and under all conditions tested in RT-PCR. However, the gene was repressed in leaf tissue in response to *Erysiphe* infection.

Closely Related Genes from Other Species

G1354 is closely related to a NAM protein encoded by polynucleotide from rice (AC005310). Similarity between G1354 and this rice protein extends beyond the signature motif of the family to a level that would suggest the genes are orthologs.

G1063: G1063 (SEQ ID NO: 119) is a member of a Glade of highly related HLH/MYC proteins that also includes G779 (SEQ ID NO: 113), G1499 (SEQ ID NO: 7), G2143 (SEQ ID NO: 129), and G2557 (SEQ ID NO: 133). All of these genes caused similar pleiotropic phenotypic effects when overexpressed, the most striking of which was the production of ectopic carpelloid tissue. These genes can be considered key regulators of carpel development. A spectrum of developmental alterations was observed amongst 35S::G1063 primary transformants and the majority were markedly small, dark green, and had narrow curled leaves. The most severely affected individuals were completely sterile and formed highly abnormal inflorescences; shoots often terminated in pin-like structures, and flowers were replaced by filamentous carpelloid structures. In other cases, flowers showed internode elongation between floral whorls, with a central carpel protruding on a pedicel-like organ. Additionally, lateral branches sometimes failed to develop and tiny patches of carpelloid tissue formed at axillary nodes of the inflorescence. In lines with an intermediate phenotype, flowers contained defined whorls of organs, but sepals were converted to carpelloid structures or displayed patches of carpelloid tissue. In contrast, lines with a weak phenotype developed relatively normal flowers and produced a reasonable quantity of seed. Such plants were still distinctly smaller than wild-type controls. Since the strongest 35S::G1063 lines were sterile, three lines with a relatively weak phenotype, that had produced sufficient seed for biochemical and physiological analysis, were selected for further study. Two of the T2 populations (T2-28,37) were clearly small, darker green and possessed narrow leaves compared to wild type. Plants from one of these populations (T2-28) also produced occasional branches with abnormal flowers like those seen in the T1. The final T2 population (T2-30) displayed a very mild phenotype. Overexpression of G1063 in *Arabidopsis* resulted in a decrease in seed oil content in T2 lines 28 and 37. No altered phenotypes were detected in any of the physiological assays, except that the plants were noted to be somewhat small and produce anthocyanin when grown in Petri plates. G1063 was expressed at low to moderate levels in roots, flowers, rosette leaves, embryos, and germinating seeds, but was not detected in shoots or siliques. It was induced by auxin. G1063 can be used to manipulate flower form and structure or plant fertility. One application for manipulation of flower structure can be in the production of saffron, which is derived from the stigmas of *Crocus sativus*. G1063 has utility in manipulating seed oil and protein content.

Closely Related Genes from Other Species

G1063 protein shared extensive homology in the basic helix loop helix region with a protein sequence encoded by *Glycine max* cDNA clone (AW832545) as well as a tomato root, plants pre-anthesis *Lycopersicon esculentum* cDNA (BE451174).

G2143: G2143 (SEQ ID NO: 129) is a member of a Glade of highly related HLH/MYC proteins that also includes G779 (SEQ ID NO: 113), G1063 (SEQ ID NO: 119), G1499 (SEQ ID NO: 7), and G2557 (SEQ ID NO: 133). All of these genes caused similar pleiotropic phenotypic effects when overexpressed, the most striking of which was the production of ectopic carpelloid tissue. These genes can be considered key regulators of carpel development. Twelve out of twenty 35S:: G2143 T1 lines showed a very severe phenotype; these plants were markedly small and had narrow, curled, dark-green leaves. Such individuals were completely sterile and formed highly abnormal inflorescences; shoots often terminated in pin-like structures, and flowers were replaced by filamentous carpelloid structures, or a fused mass of carpelloid tissue. Furthermore, lateral branches usually failed to develop, and tiny patches of stigmatic tissue often formed at axillary nodes of the inflorescence. Strongly affected plants displayed the highest levels of transgene expression (determined by RT-PCR). The remaining T1 lines showed lower levels of G2143 overexpression; these plants were still distinctly smaller than wild type, but had relatively normal inflorescences and produced seed. Since the strongest 35S::G2143 lines were sterile, three lines with a relatively weak phenotype, that had produced sufficient seed for biochemical analysis, were selected for further study. T2-11 plants displayed a very mild phenotype and had somewhat small, narrow, dark green leaves. The other two T2 populations, however, appeared wild-type, suggesting that transgene activity might have been reduced between the generations. Reduced seedling vigor was noted in the physiological assays. G2143 expression was detected at low levels in flowers and siliques, and at higher levels in germinating seed. G2143 can be used to manipulate flower form and structure or plant fertility. One application for manipulation of flower structure can be in the production of saffron, which is derived from the stigmas of *Crocus sativus*.

Closely Related Genes from Other Species

G2143 protein shared extensive homology in the basic helix loop helix region with a protein encoded by *Glycine max* cDNA clones (AW832545, BG726819 and BG154493) and a *Lycopersicon esculentum* cDNA clone (BE451174). There was lower homology outside of the region.

G2557: G2557 (SEQ ID NO: 133) is a member of a Glade of highly related HLH/MYC proteins that also includes G779 (SEQ ID NO: 113), G1063 (SEQ ID NO: 119), G1499 (SEQ ID NO: 7), and G2143 (SEQ ID NO: 129). All of these genes caused similar pleiotropic phenotypic effects when overexpressed, the most striking of which was the production of ectopic carpelloid tissue. These genes can be considered key regulators of carpel development. The flowers of 35S::G2557 primary transformants displayed patches of stigmatic papillae on the sepals, and often had rather narrow petals and poorly developed stamens. Additionally, carpels were also occasionally held outside of the flower at the end of an elongated pedicel like structure. As a result of such defects, 35S::G2557 plants often showed very poor fertility and formed small wrinkled siliques. In addition to such floral abnormalities, the majority of primary transformants were also small and darker green in coloration than wild type. Approximately one third of the T1 plants were extremely tiny and completely sterile. Three T1 lines (#7, 9, 12), that had produced some seeds, and showed a relatively weak phenotype, were chosen for further study. All three of the T2 populations from these lines contained plants that were distinctly small, had abnormal flowers, and were poorly fertile compared to controls. Stigmatic tissue was not noted on the sepals of plants from these three T2 lines. Another line (#4) that had shown a moderately strong phenotype in the T1 was sown for only morphological analysis in the T2 generation. T2-4 plants were small, dark green, and produced abnormal flowers with ectopic stigmatic tissue on the sepals, as had been seen in the parental plant. G2557 expression was detected at low to moderate levels in all tissues tested except shoots. It was induced by cold, heat, and salt, and repressed by pathogen infection. G1063 can be used to manipulate flower form and structure or plant fertility. One application for manipulation of flower structure can be in the production of saffron, which is derived from the stigmas of *Crocus sativus*.

Closely Related Genes from Other Species

G2557 protein shows extensive sequence similarity in the region of basic helix loop helix with a protein encoded by *Glycine max* cDNA clone (BE347811).

G2430: The complete sequence of G2430 (SEQ ID NO: 697) was determined G2430 is a member of the response regulator class of GARP proteins (ARR genes), although one of the two conserved aspartate residues characteristic of response regulators is not present. The second aspartate, the putative phosphorylated site, is retained so G2430 can have response regulator function. G2430 is specifically expressed in embryo and silique tissue. In morphological analyses, plants overexpressing G2430 showed more rapid growth than control plants at early stages, and in two of three lines examined produced large, flat leaves. Early flowering was observed for some lines, but this effect was inconsistent between plantings. G2430 can regulate plant growth. Overexpression of G2430 in *Arabidopsis* also resulted in seedlings that are slightly more tolerant to heat in a germination assay. Seedlings from G2430 overexpressing transgenic plants were slightly greener than the control seedlings under high temperature conditions. In a repeat experiment on individual lines, G2430 line 15 showed the strongest heat tolerant phenotype. G2430 can be useful to promote faster development and reproduction in plants.

Closely Related Genes from Other Species

G2430 had some similarity within of the conserved GARP and response-regulator domains to non-Arabidopsis proteins.

G1478: The sequence of G1478 (SEQ ID NO: 831) was determined and G1478 was analyzed using transgenic plants in which G1478 was expressed under the control of the 35S promoter. Plants overexpressing G1478 had a general delay in progression through the life cycle, in particular a delay in flowering time. G1478 is expressed at higher levels in flowers, rosettes and embryos but otherwise expression is constitutive. Based on the phenotypes produced through G1478 overexpression, G1478 can be used to manipulate the rate at which plants grow, and flowering time.

Closely Related Genes from Other Species

G1478 shows some homology to non-Arabidopsis proteins within the conserved domain.

G681: G681 (SEQ ID NO: 579) was analyzed using transgenic plants in which the gene was expressed under the control of the 35S promoter. Approximately half of the 35S::G681 primary transformants were markedly small and formed narrow leaves compared to controls. These plants often produced thin inflorescence stems, had rather poorly formed flowers with low pollen production, and set few seeds. Three T1 lines with relatively weak phenotypes, which had produced reasonable quantities of seed, were selected for further study. Plants from one of the T2 populations were noted to be slightly small, but otherwise the T2 lines displayed no consistent differences in morphology from controls. In leaves of two of the T2 lines, overexpression of G681 resulted in an increase in the percentage of the glucosinolate M39480. According to RT-PCR analysis, G681 expression was detected at very low levels in flower and rosette leaf tissues. G681 was induced by drought stress. G681 can be used to alter glucosinolate composition in plants. Increases or decreases in specific glucosinolates or total glucosinolate content are desirable depending upon the particular application. For example: (1) Glucosinolates are undesirable components of the oilseeds used in animal feed, since they produce toxic effects. Low-glucosinolate varieties of canola have been developed to combat this problem. (2) Some glucosinolates have anti-cancer activity; thus, increasing the levels or composition of these compounds might be of interest from a nutraceutical standpoint. (3) Glucosinolates form part of a plants natural defense against insects. Modification of glucosinolate composition or quantity could therefore afford increased protection from predators. Furthermore, in edible crops, tissue specific promoters can be used to ensure that these compounds accumulate specifically in tissues, such as the epidermis, which are not taken for consumption.

Closely Related Genes from Other Species

G681 shows some sequence similarity with known genes from other plant species within the conserved Myb domain.

G878: G878 (SEQ ID NO: 611) was studied using transgenic plants in which the gene was expressed under the control of the 35S promoter. Analysis of primary transformants revealed that overexpression of G878 delays the onset of flowering in *Arabidopsis*. 11/20 of the 35S::G878 T1 plants flowered approximately one week later than wild type under continuous light conditions. These plants were also darker green, had shorter stems, and senesced later than controls. G878 was ubiquitously expressed. G878 can be used to modify flowering time and senescence, and a wide variety of applications exist for systems that either lengthen or shorten the time to flowering.

Closely Related Genes from Other Species

G878 was highly related to other WRKY proteins from a variety of plant species, such as the *Nicotiana tabacum* DNA-binding protein 2 (WRKY2) (AF096299), and a *Cucumis sativus* SPF1-like DNA-binding protein (L44134).

G374: G374 (SEQ ID NO: 47) was expressed at low levels throughout the plant and was induced by salicylic acid. G374 was investigated using lines carrying a T-DNA insertion in this gene. The T-DNA insertion was approximately three quarters of the way into the protein coding sequence and should result in a null mutation. Homozygosity for a T-DNA insertion within G374 caused lethality at early stages of embryo development. In an initial screen for G374 knockouts, heterozygous plants were identified. Seed from those individuals was sown to soil and eleven plants were PCR-screened to identify homozygotes. No homozygotes were obtained; 6 of the progeny were heterozygous whilst the other 5 were wild type. This raised the prospect that homozygosity for the G374 insertion was lethal. To examine this possibility further, heterozygous KO.G374 plants were re-grown. These individuals looked wild type, but their siliques were examined for seed abnormalities. When green siliques were dissected, around 25% of developing seeds were white or aborted. Embryos from these siliques were cleared using Hoyers solution, and examined under the microscope. It was apparent that embryos from the white seeds had arrested at early (globular or heart) stages of development, whilst embryos from the normal seeds were fully developed. Such arrested or aborted seeds most likely represented homozygotes for the G374 insertion. To support this conclusion, seed was collected from heterozygous plants and sown to kanamycin plates (the T-DNA insertion carried the NPT marker gene). Of the seedlings that germinated, 160 were kanamycin resistant and 107 were kanamycin sensitive. These data more closely fitted a 2:1 (chi-sq., 1 df, =5.5, 0.05>P>0.01) than a 3:1 (chi-sq., 1 df, =32, P<0.001) ratio. Such a segregation ratio suggested that a homozygous class of kanamycin resistant seedlings was absent from the progeny of KO.G374 plant. G374 can be a herbicide target.

Closely Related Genes from Other Species

Similar sequences to G374 are present in tomato and *Medicago truncatula*, and these sequences can be orthologs.

G634 (SEQ ID NOs: 753 and 754): G634 was initially identified as public partial cDNAs sequences for GTL1 and GTL2 which are splice variants of the same gene (Smalle et al. (1998) *Proc. Natl. Acad. Sci. USA* 95: 3318-3322). The published expression pattern of GTL1 shows that G634 is highly expressed in siliques and not expressed in leaves, stems, flowers or roots.

The boundaries of G634 in were experimentally determined and the function of G634 was investigated by constitutively expressing G634 using the CaMV 35S promoter. Plants overexpressing G634 from a nucleic acid construct encoding G634 had a dramatic increase the density of trichomes that additionally appeared larger in size. The increase in trichome density was most noticeable on later arising rosette leaves, cauline leaves, inflorescence stems and sepals with the stem trichomes being more highly branched than controls. Approximately half of the primary transformants and two of three T2 lines showed the phenotype. Apart from slight smallness, there did not appear to be any other clear phenotype associated with the overexpression of G634. However, a reduction in germination was observed in T2 seeds grown in culture. It is not clear whether this defect was due to the quality of the seed lot tested or whether this characteristic is related to the transgene overexpression.

Our RT PCR data show that G634 is potentially preferentially expressed in flowers and germinating seedlings, and induced by auxin. The role of auxin in trichome initiation and development has not been established in the published literature.

Utilities. Trichome glands on the surface of many higher plants produce and secrete exudates which give protection from the elements and pests such as insects, microbes and herbivores. These exudates may physically immobilize insects and spores, may be insecticidal or ant-microbial or they may allergens or irritants to protect against herbivores. Trichome have also been suggested to decrease transpiration by decreasing leaf surface air flow, and by exuding chemicals that protect the leaf from the sun.

Depending on the plant species, varying amounts of diverse secondary biochemicals (often lipophilic terpenes) are produced and exuded or volatilized by trichomes. These exotic secondary biochemicals, which are relatively easy to extract because they are on the surface of the leaf, have been widely used in such products as flavors and aromas, drugs, pesticides and cosmetics. One class of secondary metabolites, the diterpenes, can effect several biological systems such as tumor progression, prostaglandin synthesis and tissue inflammation. In addition, diterpenes can act as insect pheromones, termite allomones, and can exhibit neurotoxic, cytotoxic and antimitotic activities. As a result of this functional diversity, diterpenes have been the target of research several pharmaceutical ventures. In most cases where the metabolic pathways are impossible to engineer, increasing trichome density or size on leaves may be the only way to increase plant productivity.

Thus, the use of G634 and its homologs to increase trichome density, size or type may therefore have profound utilities in so called molecular farming practices (i.e., the use of trichomes as a manufacturing system for complex secondary metabolites), and in producing resistant insect and herbivore resistant plants.

Example VIII

Identification of Homologous Sequences

Homologous sequences from *Arabidopsis* and plant species other than *Arabidopsis* were identified using database sequence search tools, such as the Basic Local Alignment Search Tool (BLAST) (Altschul et al. (1990) *J. Mol. Biol.* 215:403-410; and Altschul et al. (1997) *Nucl. Acid Res.* 25: 3389-3402). The tblastx sequence analysis programs were employed using the BLOSUM-62 scoring matrix (Henikoff, S, and Henikoff, J. G. (1992) *Proc. Natl. Acad. Sci. USA* 89: 10915-10919).

Identified non-Arabidopsis sequences homologous to the *Arabidopsis* sequences are provided in Table 4. The percent sequence identity among these sequences can be as low as 47%, or even lower sequence identity. The entire NCBI GenBank database was filtered for sequences from all plants except *Arabidopsis thaliana* by selecting all entries in the NCBI GenBank database associated with NCBI taxonomic ID 33090 (Viridiplantae; all plants) and excluding entries associated with taxonomic ID 3701 (*Arabidopsis thaliana*). These sequences are compared to sequences representing genes of SEQ IDs NOs:2-2N, where N=2-561, using the Washington University TBLASTX algorithm (version 2.0a19MP) at the default settings using gapped alignments with the filter "off". For each gene of SEQ IDs NOs:2-2N, where N=2-561, individual comparisons were ordered by probability score (P-value), where the score reflects the probability that a particular alignment occurred by chance. For example, a score of 3.6e–40 is $3.6 \times 10^{-40}$. In addition to P-values, comparisons were also scored by percentage identity. Percentage identity reflects the degree to which two segments of DNA or protein are identical over a particular length. Examples of sequences so identified are presented in Table 4. Homologous or orthologous sequences are readily identified and available in GenBank by Accession number (Table 4; Test sequence ID) The identified homologous polynucleotide and polypeptide sequences and homologues of the *Arabidopsis* polynucleotides and polypeptides may be orthologs of the *Arabidopsis* polynucleotides and polypeptides. (TBD: to be determined)

Example IX

Introduction of Polynucleotides into Dicotyledonous Plants

SEQ ID NOs:1-(2N–1), wherein N=2-561, paralogous, orthologous, and homologous sequences recombined into pMEN20 or pMEN65 expression vectors are transformed into a plant for the purpose of modifying plant traits. The cloning vector may be introduced into a variety of cereal plants by means well-known in the art such as, for example, direct DNA transfer or *Agrobacterium tumefaciens*-mediated transformation. It is now routine to produce transgenic plants using most dicot plants (see Weissbach and Weissbach, (1989) supra; Gelvin et al., (1990) supra; Herrera-Estrella et al. (1983) supra; Bevan (1984) supra; and Klee (1985) supra). Methods for analysis of traits are routine in the art and examples are disclosed above.

Example X

Transformation of Cereal Plants with an Expression Vector

Cereal plants such as corn, wheat, rice, sorghum or barley, may also be transformed with the present polynucleotide sequences in pMEN20 or pMEN65 expression vectors for the purpose of modifying plant traits. For example, pMEN020 may be modified to replace the NptII coding region with the BAR gene of *Streptomyces hygroscopicus* that confers resistance to phosphinothricin. The KpnI and BglII sites of the Bar gene are removed by site-directed mutagenesis with silent codon changes.

The cloning vector may be introduced into a variety of cereal plants by means well-known in the art such as, for example, direct DNA transfer or *Agrobacterium tumefaciens*-mediated transformation. It is now routine to produce transgenic plants of most cereal crops (Vasil, I., Plant Molec. Biol. 25: 925-937 (1994)) such as corn, wheat, rice, sorghum (Cassas, A. et al., Proc. Natl. Acad Sci USA 90: 11212-11216 (1993) and barley (Wan, Y. and Lemeaux, P. Plant Physiol. 104:37-48 (1994). DNA transfer methods such as the microprojectile can be used for corn (Fromm. et al. Bio/Technology 8: 833-839 (1990); Gordon-Kamm et al. Plant Cell 2: 603-618 (1990); Ishida, Y., Nature Biotechnology 14:745-750 (1990)), wheat (Vasil, et al. Bio/Technology 10:667-674 (1992); Vasil et al., Bio/Technology 11:1553-1558 (1993); Weeks et al., Plant Physiol. 102:1077-1084 (1993)), rice (Christou Bio/Technology 9:957-962 (1991); Hiei et al. Plant J. 6:271-282 (1994); Aldemita and Hodges, Planta 199:612-617; Hiei et al., Plant Mol Biol. 35:205-18 (1997)). For most cereal plants, embryogenic cells derived from immature scutellum tissues are the preferred cellular targets for transformation (Hiei et al., Plant Mol Biol. 35:205-18 (1997); Vasil, Plant Molec. Biol. 25: 925-937 (1994)).

Vectors according to the present invention may be transformed into corn embryogenic cells derived from immature scutellar tissue by using microprojectile bombardment, with the A188XB73 genotype as the preferred genotype (Fromm, et al., Bio/Technology 8: 833-839 (1990); Gordon-Kamm et al., Plant Cell 2: 603-618 (1990)). After microprojectile bombardment the tissues are selected on phosphinothricin to identify the transgenic embryogenic cells (Gordon-Kamm et al., Plant Cell 2: 603-618 (1990)). Transgenic plants are regenerated by standard corn regeneration techniques (Fromm, et al., Bio/Technology 8: 833-839 (1990); Gordon-Kamm et al., Plant Cell 2: 603-618 (1990)).

The plasmids prepared as described above can also be used to produce transgenic wheat and rice plants (Christou, Bio/Technology 9:957-962 (1991); Hiei et al., Plant J. 6:271-282 (1994); Aldemita and Hodges, Planta 199:612-617 (1996); Hiei et al., Plant Mol Biol. 35:205-18 (1997)) that coordinately express genes of interest by following standard transformation protocols known to those skilled in the art for rice and wheat Vasil, et al. Bio/Technology 10:667-674 (1992); Vasil et al., Bio/Technology 11:1553-1558 (1993); Weeks et al., Plant Physiol. 102:1077-1084 (1993)), where the bar gene is used as the selectable marker.

All references, publications, patent documents, web pages, and other documents cited or mentioned herein are hereby incorporated by reference in their entirety for all purposes. Although the invention has been described with reference to specific embodiments and examples, it should be understood that one of ordinary skill can make various modifications without departing from the spirit of the invention. The scope of the invention is not limited to the specific embodiments and examples provided.

SEQUENCE LISTING (1124 sequences)

SEQ ID NO: 1 - DNA, 748 bp, Arabidopsis thaliana
ccaagaaaagggaagatcacgcattcttataggcgtaattcgtaaatagtggtgagtatgaatgatgcagacacaaacttggggagtagtttcagcgatgatactcactctgtgttcgagtttccggagctagacttgtcagatgaatggatggatgatgatcttgtgtctgcggtttccgggatgaatcagtcttatggttatcagactagtgatgttgctggtgctttattctcaggttcttctagctgtttcagtcatcctgaatctccaagtaccaaaacttatgttgctgctacagccactgcttctgccgacaaccaaaacaagaaagaaaagaaaaaaattaaagggagagttgcgttcaagacacggtccgaggtggaagtgcttgacgacgggttcaagtggagaaagtatgggaagaagatggtgaagaacagcccacatccaagaaactactacaaatgttcagttgatggctgtcccgtgaagaaaagggttgaacgagacagagatgatccgagctttgtgataacaacttacgagggttcccacaatcactcaagcatgaactaagactcgaactaaggctcaaggcgaccatgctatattcagcacatcttattttctatggttacgaacgatacttaaaactgcttctagttctttatatccattgtaaactggttgcaggttcacaaattttgagaggtttatgacattctaaatctgtagtacttatata

SEQ ID NO: 2 - protein, 173 aa, Arabidopsis thaliana
MNDADTNLGSSFSDDTHSVFEFPELDLSDEWMDDDLVSAVSGMNQSYGYQTSDVAGALFSGSSSCFSHPESPSTKTYVAATATASADNQNKKEKKKIKGRVAFKTRSEVEVLDDGFKWRKYGKKMVKNSPHPRNYYKCSVDGCPVKKRVERDRDDPSFVITTYEGSHNHSSMN

SEQ ID NO: 3 - DNA, 1034 bp, Arabidopsis thaliana
taaagaaaaactgaacaaccctaaagtactgtataaatcctatatcaaattttttttttggaagaaaaggctatatttaaaagaaaatcaagcaaaagtagatcctcggatgtatgggaagaggccttttggaggtgatgaatctgaagaaagggaagaagatgagaacttgttcccggtcttctcggcccgatctcaacacgacatgcgtgttatggtctcggccttgactcaagtaatcggaaaccaacaaagcaaatctcatgataacatcagctctattgatgataactatccttctgtgtataatccacaagaccctaatcaacaagttgcgcctactcatcaagaccaaggggacttgaggaggagacattatagaggtgtaaggcaaaggccatggggaaagtgggcagctgaaatccgagacccaaaaaaggcggcacgtgtgtggctcgggacatttgaaaccgctgaatctgcggccttagcttatgatgaagcagccctaaagttcaaaggaagcaaagcaaaactcaatttcccggagagggttcagcttggaagtaactctacatattactcctccaaccaaattccacaaatggaaccacaaagtataccgaactataatcaatactatcatgatgcgagtagtggtgatatgctaagttttaatttgggcggtgggtatgggagtggtaccggatattcaatgtctcatgataatagtactacgactgctgctacaacttcttcgtcttctggtggctcttctaggcaacaagaagagcaagattatgccagattctggcgctttggggattcttcttcctctcctcattcgggatattaattaggagatttgatcagttacttgtgatgaagtaatgatacatttcccgtcaaaattgagatgatcatatgcttcctgaatgtttttgagtgtcatttttgtcttccgcgttaagatttattgaacgtgttttcttgtttttttggttaaaaaaaaaaaaaaaaaaaaaaaaaaaaaa

SEQ ID NO: 4 - protein, 248 aa, Arabidopsis thaliana
MYGKRPFGGDESEEREEDENLFPVFSARSQHDMRVMVSALTQVIGNQQSKSHDNISSIDDNYPSVYNPQDPNQQVAPTHQDQGDLRRRHYRGVRQRPWGKWAAEIRDPKKAARVWLGTFETAESAALAYDEAALKFKGSKAKLNFPERVQLGSNSTYYSSNQIPQMEPQSIPNYNQYYHDASSGDMLSFNLGGGYGSGTGYSMSHDNSTTTAATTSSSSGGSSRQQEEQDYARFWRFGDSSSSPHSGY

SEQ ID NO: 5 - DNA, 996 bp, Arabidopsis thaliana
atggaagatgaagcacatgaattcttccacacatctgattttgccgttgatgaccttttagttgatttctctaacgatgatgacgaagaaaacgatgttgttgctgattccaccactaccaccaccataaccgacagctctaacttctccgctgctgatcttcccagtttccacggtgatgttcaagacggcactagcttctccggtgacctttgtataccttctgatgatttggctgatgagttagagtggctttcgaacattgtggatgaatcattgtcgcctgaagatgtacacaagctcgagctaatatccggttttaagagtcgaccggacccgaaatccgataccggaagcccggaaaacccgaatagcagcagtccgatttttactaccgacgtttctgtaccggccaaagctagaagcaaacgctcacgcgccgctgcgtgtaattgggcctcacgtgggcttctcaaggaaacgttttacgacagtcctttcaccggagaaaccattctctctagccaacaacacttgtctccgccaacctcgccgcctttgttgatggctccgctagggaaaaagcaagccgttgatggaggacaccgacggaagaaggatgtttcttcaccggagtctggtggcgcagaggagagacggtgtctccactgcgccacggataagactccgcaatggcggacaggcccaatgggcccgaagacgttgtgcaacgcttgcggtgttaggtacaaatcgggacgtttagtgccggagtatcggcccgcggcgagtccgacgtttgtgctggcgaaacactcaaattctcatcggaaagttatggagctccggcgacagaaggagatgagtagggcccatcatgagttcatacatcaccatcacggtacggacactgccatgattttcgacgtttcatcggacggtgatgattacttgatccaccacaacgttggcccagatttcagacagcttatttga

SEQ ID NO: 6 - protein, 331 aa, Arabidopsis thaliana
MEDEAHEFFHTSDFAVDDLLVDFSNDDDEENDVVADSTTTTTITDSSNFSAADLPSFHGDVQDGTSFSGDLCIPSDDLADELEWLSNIVDESLSPEDVHKLELISGFKSRPDPKSDTGSPENPNSSSPIFTTDVSVPAKARSKRSRAAACNWASRGLLKETFYDSPFTGETILSSQQHLSPPTSPPLLMAPLGKKQAVDGGHRRKKDVSSPESGGAEERRCLHCATDKTPQWRTGPMGPKTLCNACGVRYKSGRLVPEYRPAASPTFVLAKHSNSHRKVMELRRQKEMSRAHHEFIHHHHGTDTAMIFDVSSDGDDYLIHHNVGPDFRQLI

SEQ ID NO: 7 - DNA, 902 bp, Arabidopsis thaliana
tcgactccttaattgcatcaccaacctaacccctcatcatatgatcacctttctttttttcctttaatatatatatatgctcacacacacacatatatatatacatataagcatcgcctcaagcattaaaatttttacgaaccaaacaaacaaaaattatgaataattataatatgaacccatctctcttccaaaattacacttggaacaacatcatcaacagcagcaacaacaacaacaagaatgatgatcatcatcatcaacataataatgatccaatcggtatggccatggaccagtacacacagctccatatcttcaatcctttctcttcttctcatttccctcctctctcttcttccctcacaaccaccactcttctctccggagatcaagaagacgacgaagacgaagaagaacctctagaggaactcggtgctatgaaggaaatgatgtacaagatcgcagccatgcaatcggttgacatcgacccagcaaccgtcaagaaacccaaacgccgtaacgtgaggatctccgacgaccctcagagtgtggcggctagacatcgccgtgagagaatcagtgagaggatcagaattcttcagagactcgtgccaggtggcactaaaatggatacggcttcaatgctcgatgaagctatacgctatgtcaagttcttgaaacggcagatccggctactcaataataataccggatatactcctccgccgccgcaagatcaagcttctcaggcggtgacgacgtcatgggtttcaccgccaccaccgccaagtttcggccgtgggggaagaggagtaggagaattaatctagacaagatgacatttccattagtagtaactaaattatgctataatgtgtgagtaatggtgcaattatgga

SEQ ID NO: 8 - protein, 224 aa, Arabidopsis thaliana
MNNYNMNPSLFQNYTWNNIINSSNNNNKNDDHHHQHNNDPIGMAMDQYTQLHIFNPFSSSHFPPLSSSLTTTTLLSGDQEDDEDEEEPLEELGAMKEMMYKIAAMQSVDIDPATVKKPKRRNVRISDDPQSVAARHRRERISERIRILQRLVPGGTKMDTASMLDEAIRYVKFLKRQIRLLNNNTGYTPPPPQDQASQAVTTSWVSPPPPPSFGRGGRGVGELI

SEQ ID NO: 9 - DNA, 828 bp, Arabidopsis thaliana
atgataaaactactatttacgtacatatgcacatacacatataaactatatgctctatatcatatggattacgcatgcgtgtgtatgtataaatataaaggcatcgtcacgcttcaagtttgtctcttttatattaaactgagagttttcctctcaaactttaccttttcttcttcgatcctagctcttaagaaccctaataattcattgatcaaaataatggcgattttgccggaaaactcttcaaacttggatcttactatctccgttccaggcttctcttcatcccctctctccgatgaaggaagtggcggaggaagagaccagctaaggctagacatgaatcggttaccgtcgtctgaagacggagacgatgaagaattcagtcacgatgatggctctgctcctccgcgaaagaaactccgtctaaccagagaacagtcacgtcttcttgaagatagtttcagacagaatcatacccttaatcccaaacaaaaggaagtacttgccaagcatttgatgctacggccaagacaaattgaagtttggtttcaaaaccgtagagcaaggagcaaattgaagcaaaccgagatggaatgcgagtatctcaaaaggtggtttggttcattaacggaagaaaaccacaggctccatagagaagtagaagagcttagagccataaaggttggcccaacaacggtgaactctgcctcgagccttactatgtgtcctcgctgcgagcgagttacccctgccgcgagcccttcgagggcggtggtgccggttccggctaagaaaacgtttccgccgcaagagcgtgatcgttga

SEQ ID NO: 10 - protein, 275 aa, Arabidopsis thaliana
MIKLLFTYICTYTYKLYALYHMDYACVCMYKYKGIVTLQVCLFYIKLRVFLSNFTFSSSILALKNPNNSLIKIMAILPENSSNLDLTISVPGFSSSPLSDEGSGGGRDQLRLDMNRLPSSEDGDDEEFSHDDGSAPPRKKLRLTREQSRLLEDSFRQNHTLNPKQKEVLAKHLMLRPRQIEVWFQNRRARSKLKQTEMECEYLKRWFGSLTEENHRLHREVEELRAIKVGPTTVNSASSLTMCPRCERVTPAASPSRAVVPVPAKKTFPPQERDR

SEQ ID NO: 11 - DNA, 1164 bp, Arabidopsis thaliana
atggcgtcgtctccgttgactgcaaatgttcagggtaccaacgcttctttgaggaatagagatgaagaaactgcagacaagcagatacaattcaatgaccaaagttttgggggaaatgactatgcacccaaggtacggaagccatacacgataacaaaagagagagagagatggacagatgaagagcacaagaagtttgttgaagccttgaaattatacgggcgagcttggagacgaatagaagaacatgtgggctcaaagaccgcagttcagattcgaagccatgctcagaagtttttctctaaggttgctcgagaagcaactggaggtgatgggagctcagtagagccgattgtaatacctcctcctcgtcccaagagaaagccagcgcatccgtaccctcgtaagtttgggaacgaggcagatcaaacaagtagatcggtttctccctcagaacgtgatactcaatctccaacctctgtgttgtccactgttggatcagaagcattgtgttcccttgattcgagttcacccaatcgaagcttgtccccagtttcttctgcatcaccaccagctgctcttacaaccactgcaaatgcacctgaagagcttgagactctgaagctggagttgtttcctagtgagagactcttaaacagggagagctcgatcaaggaaccaacgaagcaaagtcttaaactctttgggaagacagttttggtatctgattcaggcatgtcctcttctctaacaacttcaacatattgtaaatccccaattcagccattaccacggaaactctcatcatccaagacactacccataataagaaactcacaagaagaactcttgagctgctggatacaagtccctcttaagcaagaagatgtggaaaatagatgtttggattcaggaaaggctgtccaaaacgaaggatcatcgactggatcaaacactggttcggtggatgatacgggacacacggaaaagaccacagaacccgaaacaatgctatgtcaatgggagtttaaaccaagtgagaggtctgcattttctgagctcagaagaacaaactccgagtcaaattcaagaggatttggtccatacaagaagagaaagatggtaacagaagaagaagagcatgagattcatctccacttataa

SEQ ID NO: 12 - protein, 387 aa, Arabidopsis thaliana
MASSPLTANVQGTNASLRNRDEETADKQIQFNDQSFGGNDYAPKVRKPYTITKERERWTDEEHKKFVEALKLYGRAWRRIEEHVGSKTAVQIRSHAQKFFSKVAREATGGDGSSVEPIVIPPPRPKRKPAHPYPRKFGNEADQTSRSVSPSERDTQSPTSVLSTVGSEALCSLDSSSPNRSLSPVSSASPPAALTTTANAPEELETLKLELFPSERLLNRESSIKEPTKQSLKLFGKTVLVSDSGMSSSLTTSTYCKSPIQPLPRKLSSSKTLPIIRNSQEELLSCWIQVPLKQEDVENRCLDSGKAVQNEGSSTGSNTGSVDDTGHTEKTTEPETMLCQWEFKPSERSAFSELRRTNSESNSRGFGPYKKRKMVTEEEEHEIHLHL

SEQ ID NO: 13 - DNA, 1562 bp, Arabidopsis thaliana
tctttctttcttcctctttgtctctgtttcttgtttctctctctctctctctacagagttttctttccctcgaagaaaaagaatatttttaaatttaattttctctgcgtttataagctttaagtttcagaggaggaggatttagaaggagggttttgtatgtgtgtcttaaaagtggcaaatcaggaagataacgttggcaaaaaagccgagtctattagagacgatgatcatcggacgttatctgaaatcgatcaatggctttacttattcgcagccgaagacgaccaccaccgtcatagcttccctacgcagcagccgcctccatcgtcgtcgtcctcatctcttatctcaggtttcagtagagagatggagatgtctgctattgtctctgctttgactcacgttgttgctggaaatgttcctcagcatcaacaaggaggcggtgaaggtagcggagaagggacttcgaattcgtcttcttcctcggggcagaaaaggaggagagaggtggaggaaggtggcgccaaagcggttaaggcagctaatactttgacggttgatcaatatttctccggtggtagctctacttctaaagtgagagaagcttcgagtaacatgtcaggtccgggcccaacatacgagtatacaactacggcaactgctagtagcgaaacgtcgtcgtttagtggggaccaacctcggcgaagatacagaggagttagacaaagaccatggggaaagtgggcggctgagattcgagatccatttaaagcagctagagtttggctcggtacgttcgacaatgctgaatcagcagcaagagcttacgacgaagctgcacttcggtttagaggcaacaaagccaaactcaacttccctgaaaacgtcaaactcgttagacctgcttcaaccgaagcacaacctgtgcaccaaaccgctgctcaaagaccgacccagtcaaggaactcgggttcaacgactacccttttgcccataagacctgcttcgaatcaaagcgttcattcgcagccgttgatgcaatcatacaacttgagttactctgaaatggctcgtcaacaacaacagtttcagcaacatcatcaacaatctttggatttatacgatcaaatgtcgtttccgttgcgtttcggtcacactggaggttcaatgatgcaatctacgtcgtcatcatcatctcattctcgtcctctgttttccccggctgctgttcagccgccaccagaatcagctagcgaaaccggttatctccaggatatacaatggccatcagacaagactagtaataactacaataatagtccatcctcctgatgacttgcttcattttatttgtttcactatagagtaatagaaaacaggaaaatgattatatgttatagagttatttttccaaatattatagggtttaggttgtttgtattgttctgctttcatcctctcatgctttttttcttaatttattatatttttgcattataatttcgtttcattgtaacaaacattaaaaagaccacatggagaaaggaaaaaaaagagag

SEQ ID NO: 14 - protein, 391 aa, Arabidopsis thaliana
MCVLKVANQEDNVGKKAESIRDDDHRTLSEIDQWLYLFAAEDDHHRHSFPTQQPPPSSSSSSLISGFSREMEMSAIVSALTHVVAGNVPQHQQGGGEGSGEGTSNSSSSSGQKRRREVEEGGAKAVKAANTLTVDQYFSGGSSTSKVREASSNMSGPGPTYEYTTTATASSETSSFSGDQPRRRYRGVRQRPWGKWAAEIRDPFKAARVWLGTFDNAESAARAYDEAALRFRGNKAKLNFPENVKLVRPASTEAQPVHQTAAQRPTQSRNSGSTTTLLPIRPASNQSVHSQPLMQSYNLSYSEMARQQQQFQQHHQQSLDLYDQMSFPLRFGHTGGSMMQSTSSSSSHSRPLFSPAAVQPPPESASETGYLQDIQWPSDKTSNNYNNSPSS

SEQ ID NO: 15 - DNA, 765 bp, Arabidopsis thaliana
atcacagttatgtttccattcattggctataaaaaccatgctcactcccttttgttcttcacaccatttgcaggaaaaaatgaatagttgtcagtctaatcccaccaaaatggataattcagaaaatgttctatttaatgatcaaaacgaaaatttcacacttgttgcaccacacccttcttcttcgtacttgacaagagatcaagagcacgagatcatggtctctgctctgcgacaagtgatatctaactccggagctgacgacgcgtcatcatcaaacttgatcatcacaagcgttccgcctccagacgctggcccttgtcctctctgtggcgtcgccggttgctacggctgcacattacaacggccgcaccgagaggtaaagaaggagaagaaatacaaaggagtaaggaaaaaaccatcgggtaaatgggcggcggagatatgggatccgagatcgaaatcaaggaggtggcttggaacgtttcttacggcggagatggcggcacaatcttacaatgatgcggcggctgagtatcgagcaagacgtggtaaaacaaacggagaaggaattaaacggcggtggagatgactgagaaggacatggtcggtgatcatacacggcgaggtggaaatgttatatttactattgaaaactaaattatttattatagagggagatattactctttacgctttcattaagatttatttttataagttttaaagtattttattgttataaaaaaaaaaaaaaaaaaaaaa

SEQ ID NO: 16 - protein, 184 aa, Arabidopsis thaliana
MLTPFCSSHHLQEKMNSCQSNPTKMDNSENVLFNDQNENFTLVAPHPSSSYLTRDQEHEIMVSALRQVISNSGADDASSSNLIITSVPPPDAGPCPLCGVAGCYGCTLQRPHREVKKEKKYKGVRKKPSGKWAAEIWDPRSKSRRWLGTFLTAEMAAQSYNDAAAEYRARRGKTNGEGIKRRWR

SEQ ID NO: 17 - DNA, 722 bp, Arabidopsis thaliana
gagagagaaacattgatctctgaatattgtgaacatgttgaaatcaagtaacaagagaaaaagcaaagaagagaagaagttacaagaagggaagtaccttggagtgaggagacgtccatggggaagatatgcagctgaaatcagaaacccttttactaaagaaagacattggcttggaacgtttgatacagccgaagaagctgcttttgcatatgacgttgctgctcgatccatcagcggctctctagctacaacaaacttcttctacactgaaaacacctctttagaaagacatccacaacagtctttggagcctcatatgacttggggatcttctagtctctgtcttcttcaagatcagccttttgaaaacaaccattttgttgctgatcctatctcttcttctttttctcaaaaacaagagtcttctaccaatctcactaacactttctcacattgttataatgatggtgatcatgttggccaaagcaaagagatttctttacctaatgatatgtcaaacagtttattcggtcatcaggacaaagtcggtgaacatgacaatgcagaccatatgaagtttggctcagttctcagcgacgaacctctctgctttgagtatgactacattgggaattatcttcagagttttctcaaagatgtcaacgacgatgctccacagtttcttatgtgagcttgtattaccgatccttcaatttatg

SEQ ID NO: 18 - protein, 219 aa, Arabidopsis thaliana
MLKSSNKRKSKEEKKLQEGKYLGVRRRPWGRYAAEIRNPFTKERHWLGTFDTAEEAAFAYDVAARSISGSLATTNFFYTENTSLERHPQQSLEPHMTWGSSSLCLLQDQPFENNHFVADPISSSFSQKQESSTNLTNTFSHCYNDGDHVGQSKEISLPNDMSNSLFGHQDKVGEHDNADHMKFGSVLSDEPLCFEYDYIGNYLQSFLKDVNDDAPQFLM

SEQ ID NO: 19 - DNA, 827 bp, Arabidopsis thaliana
gctttctcacctttataaaatagaaaatggaaaacagctacaccgttgatggtcaccgtcttcaatattccgttccgttaagctccatgcatgaaaccagtcaaaactccgaaacttacggattatccaaagagtcgccgttggtctgcatgcccttgttcgaaaccaacactacttcattcgatatctcttctcttttctcgtttaacccaaaaccagaacccgaaaacacgcatcgtgtcatggacgattccatcgccgccgtcgtgggcgaaaacgttcttttcggtgataaaaacaaagtctctgatcacttgaccaaagaaggtggtgtgaagcgggggcggaagatgccgcagaagaccggaggattcatgggagtgagaaaacggccgtgggggagatggtcggcggagataagagacaggatagggcggtgcagacactggttaggaacgttcgacacggcggaagaggcagcgcgtgcgtatgacgcggcggcgaggaggcttagagggaccaaagccaagaccaatttcgtgattcctccgctttttcccaaggaaatagctcaggctcaggaggataataggatgaggcagaagcagaagaagaagaagaagaaaaaagtgagtgtgaggaagtgtgttaaagtcacatcggttgcacagttgttcgatgatgccaattttataaattcttctagtattaaaggaaatgtgattagttctattgataatcttgaaaaaatgggtctagagcttgatttgagtttagggttgttgtctaggaagtgataaagcactcgtagttaagtagttgtagtt

SEQ ID NO: 20 - protein, 256 aa, Arabidopsis thaliana
MENSYTVDGHRLQYSVPLSSMHETSQNSETYGLSKESPLVCMPLFETNTTSFDISSLFSFNPKPEPENTHRVMDDSIAAVVGENVLFGDKNKVSDHLTKEGGVKRGRKMPQKTGGFMGVRKRPWGRWSAEIRDRIGRCRHWLGTFDTAEEAARAYDAAARRLRGTKAKTNFVIPPLFPKEIAQAQEDNRMRQKQKKKKKKKVSVRKCVKVTSVAQLFDDANFINSSSIKGNVISSIDNLEKMGLELDLSLGLLSRK

SEQ ID NO: 21 - DNA, 804 bp, Arabidopsis thaliana
atgtcatcgtcgacgatgtacagaggagttaatatgttttcaccggcaaacacaaactggatttttcaagaagtcagagaagccacgtggacggcggaggagaacaaacggttcgagaaagctctcgcttatctggacgacaaagacaatcttgagagctggtccaagatcgcagatttgattcccggcaaaacagtagctgacgtcattaaacgatacaaggagctagaggatgatgtcagcgacatcgaagccggacttatccccattccgggatacggcggcgacgcctcctccgctgcaaacagtgactatttctttggtctagaaaactccagctacggttatgattacgtcgttggaggaaagaggagttcgccggcgatgactgattgttttaggtctccgatgccggaaaaggagaggaagaaaggagttccgtggaccgaggacgaacacctacgatttctgatgggtttgaagaaatatggaaaaggagattggagaaacatagcaaaaagctttgtgacgactcgaacgccgacgcaagtcgcttcacacgctcagaaatattttcttcgacaactcacagatggtaaagacaaaagacgatcaagtattcacgatatcaccactgttaacatccctgacgcagacgcatccgcaaccgccacgaccgctgacgtagcactctctcctactccagccaattcttttgacgttttccttcagccaaatcctcattacagtttcgcgtctgcgtctgcgtctagctattataatgcgtttccgcagtggagttaa

SEQ ID NO: 22 - protein, 267 aa, Arabidopsis thaliana
MSSSTMYRGVNMFSPANTNWIFQEVREATWTAEENKRFEKALAYLDDKDNLESWSKIADLIPGKTVADVIKRYKELEDDVSDIEAGLIPIPGYGGDASSAANSDYFFGLENSSYGYDYVVGGKRSSPAMTDCFRSPMPEKERKKGVPWTEDEHLRFLMGLKKYGKGDWRNIAKSFVTTRTPTQVASHAQKYFLRQLTDGKDKRRSSIHDITTVNIPDADASATATTADVALSPTPANSFDVFLQPNPHYSFASASASSYYNAFPQWS

SEQ ID NO: 23 - DNA, 1000 bp, Arabidopsis thaliana
atatattccctctttcattctccttcttcgtcttttctttgtttctcatattcaagacatcctcaattccaaatcttaaaccctaaatttacagacacaatcgagatcacctgaaaaaagaggtttaaagattttagcaaagatggcgaattcaggaaattatggaaagaggccctttcgaggcgatgaatcggatgaaaagaaagaagccgatgatgatgagaacatattccctttcttctctgcccgatcccaatatgacatgcgtgccatggtctcagccttgactcaagtcattggaaaccaaagcagctctcatgataataaccaacatcaacctgttgtgtataatcaacaagatcctaacccaccggctcctccaactcaagatcaagggctattgaggaagaggcactatagaggggtaagacaacgaccatggggaaagtgggcagctgaaattcgggatccgcaaaaggcagcacgggtgtggctcgggacatttgagactgctgaagctgcggctttagcttatgataacgcagctcttaagttcaaaggaagcaaagccaaactcaatttccctgagagagctcaactagcaagtaacactagtacaactaccggtccaccaaactattattcttctaataatcaaatttactactcaaatccgcagactaatccgcaaaccataccttattttaaccaatactactataaccaatatcttcatcaaggggggaatagtaacgatgcattaagttatagcttggccggtggagaaaccggaggctcaatgtataatcatcagacgttatctactacaaattcttcatcttctggtggatcttcaaggcaacaagatgatgaacaagattacgccagatatttgcgttttggggattcttcacctcctaattctggtttttgagatcttcaataaactgataataaaggatttgggtcacttgttatgaggggatcatatgttttctaa

SEQ ID NO: 24 - protein, 263 aa, Arabidopsis thaliana
MANSGNYGKRPFRGDESDEKKEADDDENIFPFFSARSQYDMRAMVSALTQVIGNQSSSHDNNQHQPVVYNQQDPNPPAPPTQDQGLLRKRHYRGVRQRPWGKWAAEIRDPQKAARVWLGTFETAEAAALAYDNAALKFKGSKAKLNFPERAQLASNTSTTTGPPNYYSSNNQIYYSNPQTNPQTIPYFNQYYYNQYLHQGGNSNDALSYSLAGGETGGSMYNHQTLSTTNSSSSGGSSRQQDDEQDYARYLRFGDSSPPNSGF

SEQ ID NO: 25 - DNA, 2526 bp, Arabidopsis thaliana
atgatggctcatcactccatggacgatagagactctcctgataaaggatttgattccggcaagtacgttagatacacgccggaacaagttgaagctcttgagagagtttatgctgagtgtcctaaacctagctctctgagaagacaacagcttattcgtgaatgtcccattctctgtaacatcgagcctcgacagatcaaagtttggttccagaatcgcagatgtcgagagaagcagaggaaagagtcagctcgtcttcagacagtgaacaggaagctgagtgctatgaacaagcttttgatggaagagaatgatcgtttgcagaagcaagtctccaacttggtttatgagaatggattcatgaaacatcgaatccacactgcttctgggacgaccacagacaacagctgtgagtctgtggtcgtgagtggtcagcaacgtcagcagcaaaacccaacacatcagcatcctcagcgtgatgttaacaacccagctaatcttctctcgattgcggaggagaccttggcggagttcctttgcaaggctacaggaactgctgtcgactgggtccagatgattgggatgaagcctggtccggattctattggtatcgtagctgtttcacgcaactgcagtggaatagcagcacgtgcctgtggcctcgtgagtttagaacccatgaaggtcgctgaaatcctcaaagatcgtccatcttggttccgtgactgtcgatgtgtcgagactctgaatgttatacccactggaaatggtggtactatcgagcttgtcaacactcagatttatgctcctacaacattagcagcagctcgtgacttttggacgctgagatatagtacaagtctagaagatggaagctatgtggtctgtgagagatcactcacttctgcaactggtggccccaatggtccactttcttcaagcttcgtgagagccaaaatgctgtcaagcgggtttcttatccgtccttgtgatggtggtggttccattattcacatcgttgatcatgtggacttggatgtctcaagtgttcctgaagtcctcaggcctctttatgagtcttccaaaatccttgctcaaaaaatgactgtcgctgctctgagacatgtgcgccaaattgctcaagagactagtggagaagtccagtatagtggtggacgccagcctgcagttttaaggactttcagccagagactctgccggggtttcaatgatgctgtaaatggttttgtcgatgatggatggtctccaatgagtagtgatggaggagaggatattacgatcatgattaactcttcctctgctaaatttgctggctcccaatacggtagctcatttcttccaagttttggaagtggtgtcctctgtgccaaagcttctatgctgttgcagaatgttccaccccttgtattgattcggttcctgagagaacaccgagctgaatgggcagactatggtgtcgatgcctattctgctgcatctctcagagcaactccatatgctgttccatgcgtcagaaccggtgggttcccgagtaaccaagtcattcttcctctcgcacagacactcgaacatgaagagtttctcgaagtggttagacttggaggtcatgcttactcacctgaagacatgggcttatcccgggatatgtatttactgcagctttgtagcggcgttgatgaaaatgtggttggaggttgtgctcagcttgtctttgccccaatcgatgaatcatttgctgatgatgcacctttgcttccttctggtttccgtgtcataccactcgaccaaaaaacaaatccgaatgatcatcaatctgcaagtcgaacacgggatctagcatcgtccctagatggttccaccaaaaccgattcggaaacaaactctagattggtcttaacaatagccttccagttcacgtttgataaccattccagagacaatgttgctacaatggcgagacagtatgtgaggaacgttgttggttcgattcagagagtggctctagccattacgcctcgtcctggctcaatgcaacttcccacttcccctgaagctctcactcttgtccgttggatcacccgtagttacagtattcatacaggtgcagatctgtttggagctgattctcagtcctgtggaggagacacattgcttaagcaactctgggaccatagtgatgccatattgtgctgctccctgaaaactaatgcctcaccggtattcacatttgcaaaccaagctggtttagacatgcttgaaactacacttgtggcacttcaggatataatgctcgacaaaacacttgatgactctggtcgtagagctctttgctccgagttcgccaagatcatgcagcagggatatgcgaatcttccggcaggaatatgtgtgtcgagcatgggcagaccggtttcgtatgagcaagcgacggtgtggaaagttgttgatgacaacgaatcaaaccactgcttggcttttaccctcgttagttggtcgtttgtttga

SEQ ID NO: 26 - protein, 841 aa, Arabidopsis thaliana
MMAHHSMDDRDSPDKGFDSGKYVRYTPEQVEALERVYAECPKPSSLRRQQLIRECPILCNIEPRQIKVWFQNRRCREKQRKESARLQTVNRKLSAMNKLLMEENDRLQKQVSNLVYENGFMKHRIHTASGTTTDNSCESVVVSGQQRQQQNPTHQHPQRDVNNPANLLSIAEETLAEFLCKATGTAVDWVQMIGMKPGPDSIGIVAVSRNCSGIAARACGLVSLEPMKVAEILKDRPSWFRDCRCVETLNVIPTGNGGTIELVNTQIYAPTTLAAARDFWTLRYSTSLEDGSYVVCERSLTSATGGPNGPLSSSFVRAKMLSSGFLIRPCDGGGSIIHIVDHVDLDVSSVPEVLRPLYESSKILAQKMTVAALRHVRQIAQETSGEVQYSGGRQPAVLRTFSQRLCRGFNDAVNGFVDDGWSPMSSDGGEDITIMINSSSAKFAGSQYGSSFLPSFGSGVLCAKASMLLQNVPPLVLIRFLREHRAEWADYGVDAYSAASLRATPYAVPCVRTGGFPSNQVILPLAQTLEHEEFLEVVRLGGHAYSPEDMGLSRDMYLLQLCSGVDENVVGGCAQLVFAPIDESFADDAPLLPSGFRVIPLDQKTNPNDHQSASRTRDLASSLDGSTKTDSETNSRLVLTIAFQFTFDNHSRDNVATMARQYVRNVVGSIQRVALAITPRPGSMQLPTSPEALTLVRWITRSYSIHTGADLFGADSQSCGGDTLLKQLWDHSDAILCCSLKTNASPVFTFANQAGLDMLETTLVALQDIMLDKTLDDSGRRALCSEFAKIMQQGYANLPAGICVSSMGRPVSYEQATVWKVVDDNESNHCLAFTLVSWSFV

SEQ ID NO: 27 - DNA, 2559 bp, Arabidopsis thaliana
atgatgatggtccattcgatgagcagagatatgatgaacagagagtcgccggataaagggttagattccggcaagtatgtgaggtacacgccggagcaagtggaagctctcgagagagtttacactgagtgtcctaagccaagttctctaagaagacaacaactcatacgtgaatgtccgattctctctaacatcgagcctaagcagatcaaagtttggtttcagaaccgcagatgtcgtgagaagcagaggaaagaagctgctcgtcttcaaacagtgaacagaaaactcaatgccatgaacaaactcttgatggaagagaatgatcgtttgcagaagcaagtttctaacttggtctatgagaatggccacatgaaacatcaacttcacactgcttctgggacgaccacagacaacagctgtgagtctgtggtcgtgagtggtcagcaacatcaacagcaaaacccaaatcctcagcatcagcaacgtgatgctaacaacccagcaggactcctttctatagcagaggaggccctagcagagttcctttccaaggctacaggaactgctgttgactgggttcagatgattgggatgaagcctggtccggattctattggcatagtcgctatttcgcgcaactgcagcggaattgcagcacgtgcctgcggcctcgtgagtttagaacccatgaaggttgctgaaattctcaaagatcgtccatcttggctccgagattgtcgaagtgtggatactctgagtgtgatacctgctggaaacggtgggacgatcgagcttatttacacgcagatgtatgctcctacgactttagcagcagctcgtgacttttggacgctgagatatagcacatgtttggaagatggaagctatgtggtttgtgaaaggtcgcttacttctgcaactggtggccccactgggccaccttcttcaaactttgtgagagctgaaatgaaaccaagcgggtttctcatccgtccttgcgatggtggtggttccattctccacattgttgatcatgttgatctggatgcctggagtgtccctgaagtcatgaggcctctctatgaatcatcgaagattcttgctcagaaaatgactgttgctgctttgagacatgtaagacaaattgcacaagaaacaagtggagaagttcagtatggtggagggcgccaacctgcggttttaagaaccttcagtcaaagactctgtcggggtttcaatgatgctgttaatggttttgtggatgatggatggtcaccaatgggtagcgatggtgcagaggatgttactgtaatgataaacttgtcccctgggaagtttggtgggtctcagtacggtaattcattccttccaagctttggtagtggcgtgctttgtgccaaggcatctatgttgcttcagaacgttccacccgctgtgctggttcgattccttagagaacaccgatctgaatgggctgattatggcgtggatgcttatgctgctgcatcgctcagagcaagtccttttgctgttccttgtgctagagctggggggttcccaagtaaccaagtcattcttcctcttgcgcagacagttgaacatgaagagtcacttgaggtggttagacttgaaggtcacgcttactcacccgaagacatgggtttagctcgggatatgtatttgctacagctttgtagcggtgttgatgaaaatgtggttggaggttgtgcacagcttgtatttgcccctatcgatgaatcatttgctgatgatgcacctttgcttccttccggtttccgcatcatacctcttgaacagaaatctactccgaacggtgcatctgcaaaccgtaccctggatttagcctcagctttagaaggatccacacgtcaagctggtgaagccgacccaaatggctgtaactttaggtcggtactaaccatagcattccagttcacatttgataaccattcaagagacagtgttgcttcaatggcacgtcagtacgtgcgaagcatagtaggatcgattcagagggttgctctagccattgctcctcgtcctggctccaatatcagtccaatatctgttcccacttcccctgaagctctcactctggtccgttggatctcccggagttacagccttcacactggtgcagatctctttggatctgattctcaaaccagtggtgacacgttgctgcatcaactctggaatcactctgatgcaatcttgtgctgctccctcaaaacaaacgcttcaccggttttcacattcgcaaaccaaaccggtttagacatgctggaaacgactcttgtagcccttcaagacataatgctagacaagacccttgacgaacctggtcgtaaagctctttgctctgagttccccaagatcatgcaacagggctatgctcatctgccggcaggagtatgtgcgtcaagcatgggaaggatggtatcttacgagcaggcaacggtgtggaaagttcttgaagacgatgaatcaaaccactgcttagctttcatgttcgtgaattggtcgttcgtttga

SEQ ID NO: 28 - protein, 852 aa, Arabidopsis thaliana
MMMVHSMSRDMMNRESPDKGLDSGKYVRYTPEQVEALERVYTECPKPSSLRRQQLIRECPILSNIEPKQIKVWFQNRRCREKQRKEAARLQTVNRKLNAMNKLLMEENDRLQKQVSNLVYENGHMKHQLHTASGTTTDNSCESVVVSGQQHQQQNPNPQHQQRDANNPAGLLSIAEEALAEFLSKATGTAVDWVQMIGMKPGPDSIGIVAISRNCSGIAARACGLVSLEPMKVAEILKDRPSWLRDCRSVDTLSVIPAGNGGTIELIYTQMYAPTTLAAARDFWTLRYSTCLEDGSYVVCERSLTSATGGPTGPPSSNFVRAEMKPSGFLIRPCDGGGSILHIVDHVDLDAWSVPEVMRPLYESSKILAQKMTVAALRHVRQIAQETSGEVQYGGGRQPAVLRTFSQRLCRGFNDAVNGFVDDGWSPMGSDGAEDVTVMINLSPGKFGGSQYGNSFLPSFGSGVLCAKASMLLQNVPPAVLVRFLREHRSEWADYGVDAYAAASLRASPFAVPCARAGGFPSNQVILPLAQTVEHEESLEVVRLEGHAYSPEDMGLARDMYLLQLCSGVDENVVGGCAQLVFAPIDESFADDAPLLPSGFRIIPLEQKSTPNGASANRTLDLASALEGSTRQAGEADPNGCNFRSVLTIAFQFTFDNHSRDSVASMARQYVRSIVGSIQRVALAIAPRPGSNISPISVPTSPEALTLVRWISRSYSLHTGADLFGSDSQTSGDTLLHQLWNHSDAILCCSLKTNASPVFTFANQTGLDMLETTLVALQDIMLDKTLDEPGRKALCSEFPKIMQQGYAHLPAGVCASSMGRMVSYEQATVWKVLEDDESNHCLAFMFVNWSFV

SEQ ID NO: 29 - DNA, 2821 bp, Arabidopsis thaliana
cggggtacccaagccacgaccgtagaatcttcttttgtctgaaaagaattacaatttacgtttctcttacgatacgacggactttccgaagaaattaatttaaagagaaaagaagaagaagccaaagaagaagaagaagctagaagaaacagtaaagtttgagactttttttgagggtcgagctaaaatggagatggcggtggctaaccaccgtgagagaagcagtgacagtatgaatagacatttagatagtagcggtaagtacgttaggtacacagctgagcaagtcgaggctcttgagcgtgtctacgctgagtgtcctaagcctagctctctccgtcgacaacaattgatccgtgaatgttccattttggccaatattgagcctaagcagatcaaagtctggtttcagaaccgcaggtgtcgagataagcagaggaaagaggcgtcgaggctccagagcgtaaaccggaagctctctgcgatgaataaactgttgatggaggagaatgataggttgcagaagcaggtttctcagcttgtctgcgaaaatggatatatgaaacagcagctaactactgttgttaacgatccaagctgtgaatctgtggtcacaactcctcagcattcgcttagagatgcgaatagtcctgctggattgctctcaatcgcagaggagactttggcagagttcctatccaaggctacaggaactgctgttgattgggttcagatgcctgggatgaagcctggtccggattcggttggcatctttgccatttcgcaaagatgcaatggagtggcagctcgagcctgtggtcttgttagcttagaacctatgaagattgcagagatcctcaaagatcggccatcttggttccgtgactgtaggagccttgaagttttcactatgttcccggctggtaatggtggcacaatcgagcttgtttatatgcagacgtatgcaccaacgactctggctcctgcccgcgatttctggaccctgagatacacaacgagcctcgacaatgggagttttgtggtttgtgagaggtcgctatctggctctggagctgggcctaatgctgcttcagcttctcagtttgtgagagcagaaatgctttctagtgggtatttaataaggccttgtgatggtggtggttctattattcacattgtcgatcaccttaatcttgaggcttggagtgttccggatgtgcttcgacccctttatgagtcatccaaagtcgttgcacaaaaaatgaccatttccgcgttgcggtatatcaggcaattagcccaagagtctaatggtgaagtagtgtatggattaggaaggcagcctgctgttcttagaacctttagccaaagattaagcaggggcttcaatgatgcggttaatgggtttggtgacgacgggtggtctacgatgcattgtgatggagcggaagatattatcgttgctattaactctacaaagcatttgaataatatttctaattctctttcgttccttggaggcgtgctctgtgccaaggcttcaatgcttctccaaaatgttcctcctgcggttttgatccggttccttagagagcatcgatctgagtgggctgatttcaatgttgatgcatattccgctgctacacttaaagctggtagctttgcttatccgggaatgagaccaacaagattcactgggagtcagatcataatgccactaggacatacaattgaacacgaagaaatgctagaagttgttagactggaaggtcattctcttgctcaagaagatgcatttatgtcacgggatgtccatctccttcagatttgtaccgggattgacgagaatgccgttggagcttgttctgaactgatatttgctccgattaatgagatgttcccggatgatgctccacttgttccctctggattccgagtcatacccgttgatgctaaaacgggagatgtacaagatctgttaaccgctaatcaccgtacactagacttaacttctagccttgaagtcggtccatcacctgagaatgcttctggaaactctttttctagctcaagctcgagatgtattctcactatcgcgtttcaattcccttttgaaaacaacttgcaagaaaatgttgctggtatggcttgtcagtatgtgaggagcgtgatctcatcagttcaacgtgttgcaatggcgatctcaccgtctgggataagcccgagtctgggctccaaattgtccccaggatctcctgaagctgttactcttgctcagtggatctctcaaagttacagtcatcacttaggctcggagttgctgacgattgattcacttggaagcgacgactcggtactaaaacttctatgggatcaccaagatgccatcctgtgttgctcattaaagccacagccagtgttcatgtttgcgaaccaagctggtctagacatgctagagacaacacttgtagccttacaagatataacactcgaaaagatattcgatgaatcgggtcgtaaggctatctgttcggacttcgccaagctaatgcaacagggatttgcttgcttgccttcaggaatctgtgtgtcaacgatgggaagacatgtgagttatgaacaagctgttgcttggaaagtgtttgctgcatctgaagaaaacaacaacaatctgcattgtcttgccttctcctttgtaaactggtcttttgtgtgattcgattgacagaaaaagactaatttaaatttacgttagagaactcaaatttttggttgttgtttaggtgtctctgttttgttttttaaaattattttgatcaaa

SEQ ID NO: 30 - protein, 842 aa, Arabidopsis thaliana
MEMAVANHRERSSDSMNRHLDSSGKYVRYTAEQVEALERVYAECPKPSSLRRQQLIRECSILANIEPKQIKVWFQNRRCRDKQRKEASRLQSVNRKLSAMNKLLMEENDRLQKQVSQLVCENGYMKQQLTTVVNDPSCESVVTTPQHSLRDANSPAGLLSIAEETLAEFLSKATGTAVDWVQMPGMKPGPDSVGIFAISQRCNGVAARACGLVSLEPMKIAEILKDRPSWFRDCRSLEVFTMFPAGNGGTIELVYMQTYAPTTLAPARDFWTLRYTTSLDNGSFVVCERSLSGSGAGPNAASASQFVRAEMLSSGYLIRPCDGGGSIIHIVDHLNLEAWSVPDVLRPLYESSKVVAQKMTISALRYIRQLAQESNGEVVYGLGRQPAVLRTFSQRLSRGFNDAVNGFGDDGWSTMHCDGAEDIIVAINSTKHLNNISNSLSFLGGVLCAKASMLLQNVPPAVLIRFLREHRSEWADFNVDAYSAATLKAGSFAYPGMRPTRFTGSQIIMPLGHTIEHEEMLEVVRLEGHSLAQEDAFMSRDVHLLQICTGIDENAVGACSELIFAPINEMFPDDAPLVPSGFRVIPVDAKTGDVQDLLTANHRTLDLTSSLEVGPSPENASGNSFSSSSSRCILTIAFQFPFENNLQENVAGMACQYVRSVISSVQRVAMAISPSGISPSLGSKLSPGSPEAVTLAQWISQSYSHHLGSELLTIDSLGSDDSVLKLLWDHQDAILCCSLKPQPVFMFANQAGLDMLETTLVALQDITLEKIFDESGRKAICSDFAKLMQQGFACLPSGICVSTMGRHVSYEQAVAWKVFAASEENNNNLHCLAFSFVNWSFV

SEQ ID NO: 31 - DNA, 785 bp, Arabidopsis thaliana
cttcttcttcacatcgatcatcatacaacaacaaaaaatggattacagagaatccaccggtgaaagtcagtcaaagtacaaaggaatccgtcgtcggaaatggggcaaatgggtatcagagattagagttccgggaactcgtgaccgtctctggttaggttcattctcaacagcagaaggtgccgccgtagcacacgacgttgctttcttctgtttacaccaacctgattctttagaatctctcaatttccctcatttgcttaatccttcactcgtttccagaacttctccgagatctatccagcaagctgcttctaacgccggcatggccattgacgccggaatcgtccacagtaccagcgtgaactctggatgcggagatacgacgacgtattacgagaatggagctgatcaagtggagccgttgaatatttcagtgtatgattatctgggcggccacgatcacgtttgatttatctcgacggtcatgatcacgtttgatcttcttttgagtaagattttgtaccataatcaaaacaggtgtggtgctaaaatcttactcaaaacaagattaggtaccacagagaaacaatcaaatggttgtgaatatacattataaggttttgattaatgtttgtttcactgatttagtgaagtttggtccattgtatacaaatctattcaagaaacctagcgcgagatcatgtttcgtgattgaagattgagatttttaagtattcgtaatatttttgtaaaatacaaataaaaaaaaaaaaaaaaaaaaa

SEQ ID NO: 32 - protein, 144 aa, Arabidopsis thaliana
MDYRESTGESQSKYKGIRRRKWGKWVSEIRVPGTRDRLWLGSFSTAEGAAVAHDVAFFCLHQPDSLESLNFPHLLNPSLVSRTSPRSIQQAASNAGMAIDAGIVHSTSVNSGCGDTTTYYENGADQVEPLNISVYDYLGGHDHV

SEQ ID NO: 33 - DNA, 1407 bp, Arabidopsis thaliana
aaagttgctagctttaatttgccaacttactattcttatgtgtaataatcgtttgcagggtcgttgatttggtgataagtcagtagaaatggataaggagaaatctccagcacctccttgtggaggtcttcctcctccatctccatcaggtcgatgctctgcattctcagaagctggtcccattggtcatggttcagatgctaatcgaatgagtcatgatattagccgtatgcttgataacccacctaagaagattggacatcggcgagctcattctgaaatacttactctccctgatgatttgagctttgatagtgatcttggtgtggttggtaatgctgctgatggagcttctttctctgatgagactgaagaagatttgctctctatgtatcttgatatggataagtttaattcttctgctacatcttctgcccaagttggtgagccatcaggaactgcttggaaaaatgagacaatgatgcagacaggcacaggctcaacttccaatcctcagaatacggttaatagtcttggcgaaaggccaagaatcaggcatcaacatagccaatctatggatggttcaatgaatatcaatgagatgcttatgtcgggaaatgaagatgattctgctattgatgctaagaagtctatgtctgctactaaacttgctgagcttgctctcattgatcctaaacgtgctaagaggatatgggcaaacaggcagtccgcagcacgatcaaaagaaaggaagacgagatacatatttgagcttgagagaaaagtacagactttgcaaacagaggctacaactctctcagcccagttgaccctcttacagagagacacaaatggcttgactgttgaaaacaatgagctgaagctgcggttacaaacaatggagcagcaggttcacttgcaggatgaactaaacgaagcactaaaggaggaaatccagcatctgaaggtgttgactggccaagttgctccatcagcgttgaactatgggtcgtttggatcaaaccagcagcaattctattccaacaatcagtcaatgcaaacaatcttagctgcaaaacagttccagcaacttcagattcattcacagaagcagcaacaacaacaacaacaacaacaacagcaacaccaacagcagcagcagcaacagcaacagtatcagtttcaacagcaacagatgcaacagcttatgcagcagcggcttcaacagcaagaacaacaaaatggagtaagactcaagccttcacaagcccagaaagagaactgaggaatatgaatatgtcccacgtaagtgagaggttctccttctgaacaattcctttctcattcataaattgttgttcatccatcacttgcagtctcttggattttagggttttagctaacaca

SEQ ID NO: 34 - protein, 398 aa, Arabidopsis thaliana
MDKEKSPAPPCGGLPPPSPSGRCSAFSEAGPIGHGSDANRMSHDISRMLDNPPKKIGHRRAHSEILTLPDDLSFDSDLGVVGNAADGASFSDETEEDLLSMYLDMDKFNSSATSSAQVGEPSGTAWKNETMMQTGTGSTSNPQNTVNSLGERPRIRHQHSQSMDGSMNINEMLMSGNEDDSAIDAKKSMSATKLAELALIDPKRAKRIWANRQSAARSKERKTRYIFELERKVQTLQTEATTLSAQLTLLQRDTNGLTVENNELKLRLQTMEQQVHLQDELNEALKEEIQHLKVLTGQVAPSALNYGSFGSNQQQFYSNNQSMQTILAAKQFQQLQIHSQKQQQQQQQQQQQHQQQQQQQQQYQFQQQQMQQLMQQRLQQQEQQNGVRLKPSQAQKEN

SEQ ID NO: 35 - DNA, 1294 bp, Arabidopsis thaliana
gaccggctaaagtcaagaacctctctctgagctctcaccactttctctctctactccctctctgcgtgtaggatactactagacaattgacaaccaaagactaaagctgtgttgttggttcacttctgttctcttttccaatgttgtcatcagctaagcatcagagaaaccatagactctctgctacaaacaagaaccagactctcaccaaagtttcttccatttcatcctcatcaccatcgtcttcttcttcatcatcatcaacctcatcatcatctcctttaccttctcaagactctcaagcccagaagagatctcttgtcaccatggaagaagtttggaatgacatcaaccttgcttccatccaccacctaaaccgacacagccctcatccacaacacaaccacgagccaaggttcaggggccaaaaccaccacaaccaaaaccctaactcaatcttccaagattttctcaaaggatctttgaaccaggaaccagcacccacaagccagaccacgggttctgcgcctaatggcgattccaccacggtcactgttctttacagctctccttttccacctcctgcaactgttctgagcttgaattccggcgctggcttcgagtttctcgataaccaagatcctcttgttacctcaaactctaatcttcatacccaccatcacctctcaaacgctcatgccttcaacacctctttcgaggctctggttccatccagttcttttggtaagaaaagaggccaagattccaatgaaggttcagggaatagaagacataagcgtatgatcaagaacagagaatctgcagctcgttcccgcgctaggaaacaggcttatacaaacgagttagaacttgaagttgctcacttgcaggcagaaaatgcaagactcaagagacaacaagatcaaaaaatggctgcagcaattcagcaacccaaaaagaacacacttcaacggtcttccacagctccattttgagaaatctacaagtccttgtttctcttttggggattgagattgtctcatgaagaagtgaaaaaatggcaaaagtttgtacccttttttattagctataagtataactaagcctaaaattgtagaactaagatattgtaggggaaaaaagaagatgtaaaacaaaagacccggaaagagaaaaggatctttcaatttcctaaggcacaggaacacctgtcctgggtcctctcttaatgttctgtcgttttcctatgcaaacccttttttcacttctgtactaacttatacttgtattcttg

SEQ ID NO: 36 - protein, 284 aa, Arabidopsis thaliana
MLSSAKHQRNHRLSATNKNQTLTKVSSISSSSPSSSSSSSSTSSSSPLPSQDSQAQKRSLVTMEEVWNDINLASIHHLNRHSPHPQHNHEPRFRGQNHHNQNPNSIFQDFLKGSLNQEPAPTSQTTGSAPNGDSTTVTVLYSSPFPPPATVLSLNSGAGFEFLDNQDPLVTSNSNLHTHHHLSNAHAFNTSFEALVPSSSFGKKRGQDSNEGSGNRRHKRMIKNRESAARSRARKQAYTNELELEVAHLQAENARLKRQQDQKMAAAIQQPKKNTLQRSSTAPF

SEQ ID NO: 37 - DNA, 1054 bp, Arabidopsis thaliana
ccaaaaaacaaagcattctatgctattctgttctgttctccaatgttgtcatcagcaaagcataataagatcaacaaccatagtgccttttcaatttcctcttcatcatcatcattatcaacatcatcctccctaggccataacaaatctcaagtcaccatggaagaagtatggaaagaaatcaaccttggttcacttcactaccatcggcaactaaacattggtcatgaaccaatgttaaagaaccaaaaccctaataactccatctttcaagatttcctcaacatgcctctgaatcaaccaccaccaccaccaccaccaccttcctcttccaccattgtcactgctctctatggctctctgcctcttccgcctcctgccactgtcctcagcttaaactccggtgttggattcgagtttcttgataccacagaaaatcttcttgcttctaaccctcgctcctttgaggaatctgcaaagtttggttgtcttggtaagaaaagaggccaagattctgatgatactagaggagacagaaggtataagcgtatgatcaagaacagagaatctgctgctcgttcaagggctaggaagcaggcatatacaaacgaacttgagcttgaaattgctcacttgcagacagagaatgcaagactcaagatacaacaagagcagctgaaaatagccgaagcaactcaaaaccaagtaaagaaaacactacaacggtcttccacagctccattttgagaaaaatctactatttctttttgggggagtttcaagtgtttcttatgaagatgagaaaaacagaaaaagtttgtacattttagctaagttaaatttgtggtggtaagtaatgtaaaagaaaagtgtgtgtagaagaaaagtgtctagaaaaagaaagcaactaactttcttcttcttctctggtttcctatcaactcttttgacttttgtactttttttcttctctacttaacctctattattgtaatgccaagtcaagtccttatctagctagtacatgagtttctgttttcactggttaagccat

SEQ ID NO: 38 - protein, 234 aa, Arabidopsis thaliana
MLSSAKHNKINNHSAFSISSSSSSLSTSSSLGHNKSQVTMEEVWKEINLGSLHYHRQLNIGHEPMLKNQNPNNSIFQDFLNMPLNQPPPPPPPPSSSTIVTALYGSLPLPPPATVLSLNSGVGFEFLDTTENLLASNPRSFEESAKFGCLGKKRGQDSDDTRGDRRYKRMIKNRESAARSRARKQAYTNELELEIAHLQTENARLKIQQEQLKIAEATQNQVKKTLQRSSTAPF

SEQ ID NO: 39 - DNA, 1519 bp, Arabidopsis thaliana
ttttttcttttctttctttttttgctggtgtgagaaattgtacgcttactatctctctctctctctgccagattctctctttttgatgatgtgaaagttgtgcttttgtttcttaagaaaaaggcatatttttaatacttgattcttggttcttgattcttgattcttggttttttttagcttcttaagttcggtgatgtcgtcttccaccaatgactacaacgatggtaataacaatggagtgtaccctctctctctttacctttcttcactctctggccatcaagacatcattcataatccctacaaccatcagttaaaagcatctccgggccatatggtatcagcagttcctgaatctctgatcgattacatggcgtttaagtcaaataatgttgtgaatcaacaaggctttgagtttcctgaggtgtcaaaggaaatcaagaaggtggtgaagaaggaccgacatagcaagattcaaacggcacaagggattagagacaggagggttaggctttttattgggattgctcgccaattctttgatcttcaggatatgttggggtttgataaagctagtaaaacgttagactggctgctcaagaagtcaagaaaagccatcaaagaggtcgtacaagcaaaaaacctcaacaatgatgatgaagattttggaaacattggaggcgatgtagaacaagaagaggagaaggaggaggatgacaatggcgataagagcttcgtgtatggtttgagccccgggtacggtgaagaagaagtggtatgtgaggccacgaaggcagggataagaaagaagaagagtgagttgagaaacatctcatcaaaggggctaggagccaaagctagaggaaaagcaaaggagcgaacaaaagagatgatggcctatgataatccagagactgcctctgatattacacaatctgaaatcatggacccattcaagaggtctatagtcttcaatgaaggagaagatatgacacaccttttctacaaggaaccaatcgaggagtttgataatcaagaatctatcttaaccaatatgactctaccaacgaagatgggtcaaagttacaatcaaaataatgggatacttatgttggtagatcagagttctagcagcaactataatacatttctgcctcaaaatttggattatagttatgatcaaaacccttttcatgaccaaaccttatatgtagtcaccgacaaaaatttccccaaaggtttcctataaatctcgacagttttgaaggactatgcatgatcaagtttaaacatgtaagccaatatagtcccttattcctctgaatgtatacaaaatctatagttatgtatatctgttcctttttaacgtatctttattgatcttctgtgccttgatcaaaattgtcattttaagattcagtttgtgtaatattttagctacaacttttaagtggtattattgtaaccttttgaactatatattttgaagatgaataagaacatgtttatataaaaa

SEQ ID NO: 40 - protein, 351 aa, Arabidopsis thaliana
MSSSTNDYNDGNNNGVYPLSLYLSSLSGHQDIIHNPYNHQLKASPGHMVSAVPESLIDYMAFKSNNVVNQQGFEFPEVSKEIKKVVKKDRHSKIQTAQGIRDRRVRLFIGIARQFFDLQDMLGFDKASKTLDWLLKKSRKAIKEVVQAKNLNNDDEDFGNIGGDVEQEEEKEEDDNGDKSFVYGLSPGYGEEEVVCEATKAGIRKKKSELRNISSKGLGAKARGKAKERTKEMMAYDNPETASDITQSEIMDPFKRSIVFNEGEDMTHLFYKEPIEEFDNQESILTNMTLPTKMGQSYNQNNGILMLVDQSSSSNYNTFLPQNLDYSYDQNPFHDQTLYVVTDKNFPKGFL

SEQ ID NO: 41 - DNA, 834 bp, Arabidopsis thaliana
aaaaaaaccaaacataaaacataaaactctgtcctttttttgtcttcttgtaacttttcttgttaaaaatcaatggcgtcatctagcagcacataccggagctcaagctcttccgacggtggtaataataacccgtcggactccgtcgtcaccgtcgacgaacgaaaacgtaaaagaatgttatcgaacagagaatctgcacgtaggtcaaggatgcgtaaacagaaacacgttgatgatctaacggctcagatcaatcagctatcaaacgacaaccgtcagatcttgaacagcctcaccgtaacatctcagctttacatgaagatccaagccgagaactctgttctcaccgctcagatggaggagcttagcaccagactccaatctctcaacgagatcgttgatcttgttcaatccaacggtgcaggatttggtgttgaccagatcgacggctgtggttttgatgatcgtacggttgggatcgacggatattacgatgatatgaatatgatgagtaatgttaatcattggggtggttcggtttacactaaccaacccattatggctaatgatatcaatatgtattgattaataaaattaattaaaataattagatgccccttttttgtctttttattttaaaatttagcccattttggtgtttttgggttggtgtgatgatgtaattatagtacatgcatctttgattggttggaaggataaatataaactttatatatatattggggcatatatatatgagttgtactttgcatgtattggtgtgtgttttgttataattatatgattatatatgtttatgttaaaaaaaaa

SEQ ID NO: 42 - protein, 171 aa, Arabidopsis thaliana
MASSSSTYRSSSSSDGGNNNPSDSVVTVDERKRKRMLSNRESARRSRMRKQKHVDDLTAQINQLSNDNRQILNSLTVTSQLYMKIQAENSVLTAQMEELSTRLQSLNEIVDLVQSNGAGFGVDQIDGCGFDDRTVGIDGYYDDMNMMSNVNHWGGSVYTNQPIMANDINMY

SEQ ID NO: 43 - DNA, 1338 bp, Arabidopsis thaliana
atgcttacttccttcaaatcctctagctcctcctccgaagatgccaccgctaccaccaccgagaatcctcctcctttgtgcatcgcctcctcctcggccgcaacctccgcctcacatcacctccgtcgtcttcttttcaccgctgcgaatttcgtctcccagtcaaacttcaccgccgctcaaaacttactctcaatcctctcccttaactcttctcctcacggcgactccaccgagcgacttgtacacctcttcactaaagccttgtccgtacgaatcaaccgtcagcaacaagatcagacggctgaaacggttgccacgtggacgacgaacgaaatgacgatgagtaactccacggtgttcacgagcagtgtatgcaaagaacagttcttgtttcgaaccaagaacaacaattctgacttcgagtcttgttactatctttggctaaaccaactaacgccgtttattcggttcggtcatttaacggcgaaccaagctatcctcgacgcgacggagacaaacgataacggagctctacatatacttgatttagatatatcacaaggacttcaatggcctccattgatgcaagccctagcagagaggtcatcaaaccctagcagtccacctccatctctccgcataaccggatgcggtcgagatgtaaccggattaaaccgaactggagaccggttaacccggttcgctgactctttaggtctccaattccagtttcacacgctagtgatcgtagaagaagatctcgccggacttttgctacagatccgattgttagctctctcagccgtacaaggagagaccattgccgtcaattgtgttcacttcctccacaaaatatttaacgacgatggagatatgatcggtcacttcttgtcagcgatcaagagcttaaactctagaatcgttacaatggcagagagagaagctaatcatggagatcactcgttcttgaatagattctctgaggcagtggatcattacatggcgatctttgattcgttggaagcgacgttgccgccaaatagccgagagagactaaccctagagcaacggtggttcggtaaggagattttggatgttgtggcggcggaagagacggagagaaagcaaagacatcggaggtttgagatttgggaagagatgatgaagaggtttggtttcgttaacgttcctattggaagctttgctttgtctcaagctaagcttcttcttagacttcattatccttcagaaggttataatcttcagttccttaacaattctttgtttcttggctggcaaaatcgtcccctcttctccgtttcgtcgtggaaatga

SEQ ID NO: 44 - protein, 445 aa, Arabidopsis thaliana
MLTSFKSSSSSSEDATATTTENPPPLCIASSSAATSASHHLRRLLFTAANFVSQSNFTAAQNLLSILSLNSSPHGDSTERLVHLFTKALSVRINRQQQDQTAETVATWTTNEMTMSNSTVFTSSVCKEQFLFRTKNNNSDFESCYYLWLNQLTPFIRFGHLTANQAILDATETNDNGALHILDLDISQGLQWPPLMQALAERSSNPSSPPPSLRITGCGRDVTGLNRTGDRLTRFADSLGLQFQFHTLVIVEEDLAGLLLQIRLLALSAVQGETIAVNCVHFLHKIFNDDGDMIGHFLSAIKSLNSRIVTMAEREANHGDHSFLNRFSEAVDHYMAIFDSLEATLPPNSRERLTLEQRWFGKEILDVVAAEETERKQRHRRFEIWEEMMKRFGFVNVPIGSFALSQAKLLLRLHYPSEGYNLQFLNNSLFLGWQNRPLFSVSSWK

SEQ ID NO: 45 - DNA, 1146 bp, Arabidopsis thaliana
atgaggcttaatggggattcgggtccgggtcaggatgaacccggttcgagcgggtttcacggcggaatcagacgattcccgttagcagctcagccggagattatgagagctgctgagaaagacgatcaatacgcttctttcatccacgaagcttgccgcgatgccttccgacaccttttcggtacaagaatcgctcttgcttaccagaaggagatgaagctacttggacagatgctttactatgttcttacgacaggttcagggcaacaaactttaggagaggaatattgtgacattatacaggttgcagggccttatggactctctcctacaccagctagacgtgctttgttcatattgtaccagaccgcagttccatatatcgcagagagaattagcactcgagctgctacgcaagcagtcacctttgatgagtctgatgagttttttggtgatagtcatatccactcaccaagaatgatagatcttccatcttcatctcaagttgaaacttcaacttctgtagtatctaggttaaacgatagacttatgagatcgtggcaccgagctattcagcgatggcctgtggttcttcctgttgcccgcgaagtcttacaactggttttgcgtgccaatctgatgctcttctactttgaaggtttttattatcatatatcgaaacgtgcatccggggttcgttatgttttcataggaaagcaactgaatcagagacctagataccaaattcttggggttttccttctaatccaattgtgcatccttgctgctgagggcttgcgtcggagtaatttgtcatctatcactagctccattcagcaggcttctataggatcttatcaaacttcaggagggagaggtttacctgttttaaatgaagaggggaatttgataacttcggaagctgaaaagggaaactggtctacctccgattcaacttcaacggaggcagtagggaaatgcactctctgcttaagcacccgtcagcacccaacggccactccttgtggtcatgtgttttgttggagctgcattatggaatggtgcaacgagaagcaagaatgccctctttgtcgaacgcccaatacccattcaagtttggtttgtttgtatcattctgatttttag

SEQ ID NO: 46 - protein, 381 aa, Arabidopsis thaliana
MRLNGDSGPGQDEPGSSGFHGGIRRFPLAAQPEIMRAAEKDDQYASFIHEACRDAFRHLFGTRIALAYQKEMKLLGQMLYYVLTTGSGQQTLGEEYCDIIQVAGPYGLSPTPARRALFILYQTAVPYIAERISTRAATQAVTFDESDEFFGDSHIHSPRMIDLPSSSQVETSTSVVSRLNDRLMRSWHRAIQRWPVVLPVAREVLQLVLRANLMLFYFEGFYYHISKRASGVRYVFIGKQLNQRPRYQILGVFLLIQLCILAAEGLRRSNLSSITSSIQQASIGSYQTSGGRGLPVLNEEGNLITSEAEKGNWSTSDSTSTEAVGKCTLCLSTRQHPTATPCGHVFCWSCIMEWCNEKQECPLCRTPNTHSSLVCLYHSDF

SEQ ID NO: 47 - DNA, 1359 bp, Arabidopsis thaliana
atggacaacaaaaatgatcaggatattgatgttagatcagtggttgaagctgtttccgccgatctttcctttggtgctcccctctatgtggttgagagcatgtgcatgcgctgccaagaaaatggaacaaccagatttctattgaccttaattcctcacttcagaaaggtcttaatatctgcatttgaatgtccgcattgcggggaaaggaataatgaagttcagttcgcaggcgagattcaaccccgtggatgctgttacaatctagaggttctagctggtgatgtgaagatatttgaccggcaagttgtgaaatctgaatcagccactattaagattcctgaactggattttgagattccaccagaggcccaacgtggaagtttgtctactgtggaagggatattagcacgggctgctgatgaactgagtgcccttcaagaagaacgcaagaaagttgatcctaaaactgctgaagcaatagaccaattcttgtccaaactgagagcttgtgctaaagcagagacatccttcaccttcattttggatgatcctgctggaaacagtttcattgagaacccacatgctccatcaccagatccctctctaaccatcaaattctatgagcgaacaccagagcaacaagcaacacttggatatgttgctaacccatctcaggctggacaatcagaaggaagccttggcgcacctgtgatgactttcccttcaacttgcggagcatgtacggagccgtgtgagacacggatgttcaaaatagaaatcccgtactttcaggaagttattgtcatggcatctacatgtgacagttgtggctatcgtaattctgagttgaagcctggtggtgcaattcctgaaaagggaaagaagattactctctctgtgaggaacattacagaccttagccgagatgttatcaagtcggacactgcaggagtgataatcccagaacttgatctggagctagctggtggtacacttggtggaatggtaacaacagttgaagggttggttacacagatcagagaaagcctagcgagagttcacggattcacttttggtgatagtatggaagagagtaagttgaacaaatggagagaatttggagccaggctcactaagctcctaagctttgaacagccgtggacattgattcttgatgatgaattagcaaattcctttattgcaccagtaacagatgatatcaaagatgaccatcagctcacatttgaagagtacgagaggtcatgggatcaaaacgaggagttgggtctcaacgacatagatacttcttcagctgatgctgcttatgaatccacagagacgactaaattaccttaa

SEQ ID NO: 48 - protein, 452 aa, Arabidopsis thaliana
MDNKNDQDIDVRSVVEAVSADLSFGAPLYVVESMCMRCQENGTTRFLLTLIPHFRKVLISAFECPHCGERNNEVQFAGEIQPRGCCYNLEVLAGDVKIFDRQVVKSESATIKIPELDFEIPPEAQRGSLSTVEGILARAADELSALQEERKKVDPKTAEAIDQFLSKLRACAKAETSFTFILDDPAGNSFIENPHAPSPDPSLTIKFYERTPEQQATLGYVANPSQAGQSEGSLGAPVMTFPSTCGACTEPCETRMFKIEIPYFQEVIVMASTCDSCGYRNSELKPGGAIPEKGKKITLSVRNITDLSRDVIKSDTAGVIIPELDLELAGGTLGGMVTTVEGLVTQIRESLARVHGFTFGDSMEESKLNKWREFGARLTKLLSFEQPWTLILDDELANSFIAPVTDDIKDDHQLTFEEYERSWDQNEELGLNDIDTSSADAAYESTETTKLP

SEQ ID NO: 49 - DNA, 2603 bp, Arabidopsis thaliana
caaagattagactaatccgactgtgtttttaatcaatcatcattttatttaggggagagaagttgtaaagttttgatttttttttctgggttttttctgtgagacccagaagaagaacagagagaggaagaaggagaagaaaaaaatatctctttctctccggctttcaacaaaatctctcttttttccttcatcagtgttaaattcggatccgggtcgggtgggttttcggtttttggtgttcggatcagagcacagttggatgttagcgacggaactgaggatttcagtttgcggctgcggcggctgtgacggtgtttgtgtgtcgtcttcttttatcaatcaggagtttcatcacagtttgatcagagattcagccaaattcttggatactaaatggctggttttgatgaaaatgttgctgtgatgggagaatgggtgcctcgtagtcctagtcccgggacacttttctcctctgctattggagaagagaagagctcgaaacgtgttcttgaaagagagttatctttgaatcatggtcaagttattggtttagaagaagacactagtagtaatcataacaaggattcttcacaaagcaatgtttttcgaggtggtctcagtgaaagaattgctgcaagagctggatttaatgctccaaggttgaacactgagaatatccgcaccaacaccgacttttccattgactctaaccttcgatctccttgcttaaccatctcttctcctggccttagccctgcaacactcttggaatctcctgttttcctttctaacccattggctcaaccttctccaactaccgggaaatttccatttcttcctggtgttaatggtaatgcattgtcttctgagaaagcgaaagacgagttctttgatgatattggagcatcattcagcttccatcctgtttcaagatcatcttcctctttcttccaaggcacaacagagatgatgtcagttgattatggtaactacaacaatagatcttcttctcatcaatccgcagaagaagtaaaacctggctctgaaaacatagaaagctccaatctttatgggattgaaactgacaatcaaaacgggcagaacaagacatctgatgtcactacaaacaccagtcttgaaaccgtggatcatcaagaggaagaagaagagcaaagacgcggtgattcgatggctggtggtgcgcctgcagaggatggatataactggaggaaatacggacaaaagttggtcaaaggaagtgagtatccgcgaagctattacaagtgcacaaacccgaattgtcaggtgaagaagaaagttgagagatcaagggaaggtcacatcacagagattatatacaaaggagctcataatcatcttaaacctccacctaatcgccgctcagggatgcaagtagatggaactgaacaagttgaacaacaacaacaacagagagattctgctgcaacgtgggttagttgtaataacactcaacaacaaggtggaagcaatgagaacaatgtcgaagagggatctacgagattcgagtatggaaaccaatctggatcaattcaagctcaaaccggaggtcaatacgagtcaggtgatcctgtggttgtggttgatgcttcttcaacattctctaatgatgaagatgaagatgatcgagggacacatggaagtgtttctttgggttacgatggaggaggaggaggtgggggaggagaaggagatgaatcagagtcgaaaagaaggaaactagaagcttttgcagcagagatgagtggatcaacaagagccatacgtgagccaagagttgttgtgcagacaacgagtgatgttgacattcttgatgatggttatcgctggcgaaaatatggtcagaaagttgtcaaaggcaatccaaatccaaggagttattacaaatgcacagctccaggatgtacagtgaggaaacatgttgaaagagcttctcatgatctcaaatccgttataacaacttacgaaggcaaacataaccatgacgtccccgctgcacgcaacagcagccacggaggcggtggtgatagtggtaacggtaacagcggcggttcagccgcagtttctcaccattaccacaacggtcatcactcagagccgccacgtgggagattcgacagacaagtcacaactaacaatcagtctccttttagccgtccctttagctttcagccacatttgggtcctccttctggtttctccttcggtttaggacaaaccggtttggttaatctttcaatgcctggtttagcgtatggtcaagggaaaatgccgggtttgcctcacccgtatatgacacaaccggttgggatgagtgaagcaatgatgcagagagggatggaaccaaaggttgaaccggtttcagattcaggacaatcggtatataaccagatcatgagtagattacctcagatttgaaatttactcttcttcttcttcttctgcatttggtcactccttataataacttttaatttctgcttcttcttcttctttcatttattggtttcaaactttggggaaggtaaaggctgttttattgttaaaaaaaaaaaaaaaaa

SEQ ID NO: 50 - protein, 687 aa, Arabidopsis thaliana
MAGFDENVAVMGEWVPRSPSPGTLFSSAIGEEKSSKRVLERELSLNHGQVIGLEEDTSSNHNKDSSQSNVFRGGLSERIAARAGFNAPRLNTENIRTNTDFSIDSNLRSPCLTISSPGLSPATLLESPVFLSNPLAQPSPTTGKFPFLPGVNGNALSSEKAKDEFFDDIGASFSFHPVSRSSSSFFQGTTEMMSVDYGNYNNRSSSHQSAEEVKPGSENIESSNLYGIETDNQNGQNKTSDVTTNTSLETVDHQEEEEEQRRGDSMAGGAPAEDGYNWRKYGQKLVKGSEYPRSYYKCTNPNCQVKKKVERSREGHITEIIYKGAHNHLKPPPNRRSGMQVDGTEQVEQQQQQRDSAATWVSCNNTQQQGGSNENNVEEGSTRFEYGNQSGSIQAQTGGQYESGDPVVVVDASSTFSNDEDEDDRGTHGSVSLGYDGGGGGGGGEGDESESKRRKLEAFAAEMSGSTRAIREPRVVVQTTSDVDILDDGYRWRKYGQKVVKGNPNPRSYYKCTAPGCTVRKHVERASHDLKSVITTYEGKHNHDVPAARNSSHGGGGDSGNGNSGGSAAVSHHYHNGHHSEPPRGRFDRQVTTNNQSPFSRPFSFQPHLGPPSGFSFGLGQTGLVNLSMPGLAYGQGKMPGLPHPYMTQPVGMSEAMMQRGMEPKVEPVSDSGQSVYNQIMSRLPQI

SEQ ID NO: 51 - DNA, 954 bp, Arabidopsis thaliana
atgggaagacctccttgttgtgacaagtccaatgtcaagaaaggtctctggaccgaggaagaagacgctaagatccttgcttatgttgctatccatggtgtaggaaactggagcttgatccccaaaaaagcaggtctgaatcgatgtggaaagagctgtagactaagatggactaattacttaagacctgaccttaaacatgacagcttctctacccaagaagaagagcttatcattgagtgtcatagagccattggcagcaggtggtcttccattgcacgaaagcttccaggaagaacggataatgatgtgaagaatcactggaacacaaagctgaagaagaagctgatgaaaatggggatagacccggtgactcataaaccggtttctcaactccttgcagaattcagaaacattagcggccatggaaatgcatccttcaaaacagaaccatctaacaactctatactcacacaatccaactcagcttgggaaatgatgagaaacacaacaacaaaccatgagagttattacaccaactctccaatgatgtttacaaattcctctgagtaccaaactactccatttcatttctatagccatccaaatcatctgctcaatggaaccacatcttcatgctcttcctcatcatcttctactagtatcactcagccaaaccaagtacctcaaacaccggttactaacttctactggagcgatttccttctctcggacccggttcctcaagtagtgggatcctcagctactagcgacctcacttttacgcagaacgaacatcatttcaacatcgaagccgaatacatctctcaaaacatcgattcaaaggcctcgggaacatgtcattccgcgagttccttcgttgacgaaatactagataaagaccaagagatgttgtcacagtttcctcaactcttgaatgatttcgattattag

SEQ ID NO: 52 - protein, 317 aa, Arabidopsis thaliana
MGRPPCCDKSNVKKGLWTEEEDAKILAYVAIHGVGNWSLIPKKAGLNRCGKSCRLRWTNYLRPDLKHDSFSTQEEELIIECHRAIGSRWSSIARKLPGRTDNDVKNHWNTKLKKKLMKMGIDPVTHKPVSQLLAEFRNISGHGNASFKTEPSNNSILTQSNSAWEMMRNTTTNHESYYTNSPMMFTNSSEYQTTPFHFYSHPNHLLNGTTSSCSSSSSSTSITQPNQVPQTPVTNFYWSDFLLSDPVPQVVGSSATSDLTFTQNEHHFNIEAEYISQNIDSKASGTCHSASSFVDEILDKDQEMLSQFPQLLNDFDY

SEQ ID NO: 53 - DNA, 1473 bp, Arabidopsis thaliana
tctcaagcttctctctcctttttttcccatagcacatcagaatcgctaaatacgactcctatgcaaagaagaagctacttctttctcttgccctaattaatctacctaactagggtttcctcttacctttcatgagagagatcatttaacataagtcaccttttttatatcttttgcttcgtctttaatttagttctgttcttggtctgtttctatattttgtcggcttgcgtaaccgatcacaccttaatgctttagctattgtttcctcaaaatcatgagttttgacttctcgatctgagttttctttttctctctttacgctcttcttcacctagctaccaatatatgaacgagcaggatcaagaatcgagaaattgatttgagctggcgaataagcagtggtgggatagggaattagtagatgcggcggcgatggaaggcggttacgagcaaggcggtggagcttctagatacttccataacctctttagaccggagattcaccaccaacagcttcaaccgcagggcgggatcaatcttatcgaccagcatcatcatcagcaccagcaacatcaacaacaacaacaaccgtcggatgattcaagagaatctgaccattcaaacaaagatcatcatcaacagggtcgacccgattcagacccgaatacatcaagctcagcaccgggaaaacgtccacgtggacgtccaccaggatctaagaacaaagccaagccaccgatcatagtaactcgtgatagccccaacgcgcttagatctcacgttcttgaagtatctcctggagctgacatagttgagagtgtttccacgtacgctaggaggagagggagaggcgtctccgttttaggaggaaacggcaccgtatctaacgtcactctccgtcagccagtcactcctggaaatggcggtggtgtgtccggaggaggaggagttgtgactttacatggaaggtttgagattctttcgctaacggggactgttttgccacctcctgcaccgcctggtgccggtggtttgtctatatttttagccggagggcaaggtcaggtggtcggaggaagcgttgtggctccccttattgcatcagctccggttatactaatggcggcttcgttctcaaatgcggttttcgagagactaccgattgaggaggaggaagaagaaggtggtggtggcggaggaggaggaggaggagggccaccgcagatgcaacaagctccatcagcatctccgccgtctggagtgaccggtcagggacagttaggaggtaatgtgggtggttatgggttttctggtgatcctcatttgcttggatggggagctggaacaccttcaagaccacctttttaattgaattttaatgtccggaaatttatgtgtttttatcatcttgaggagtcgtctttcctttgggatatttggtgtttaatgtttagttgatatgcatatttt

SEQ ID NO: 54 - protein, 311 aa, Arabidopsis thaliana
MEGGYEQGGGASRYFHNLFRPEIHHQQLQPQGGINLIDQHHHQHQQHQQQQQPSDDSRESDHSNKDHHQQGRPDSDPNTSSSAPGKRPRGRPPGSKNKAKPPIIVTRDSPNALRSHVLEVSPGADIVESVSTYARRRGRGVSVLGGNGTVSNVTLRQPVTPGNGGGVSGGGGVVTLHGRFEILSLTGTVLPPPAPPGAGGLSIFLAGGQGQVVGGSVVAPLIASAPVILMAASFSNAVFERLPIEEEEEEGGGGGGGGGGGPPQMQQAPSASPPSGVTGQGQLGGNVGGYGFSGDPHLLGWGAGTPSRPPF

SEQ ID NO: 55 - DNA, 1084 bp, Arabidopsis thaliana
tttgtgtttggtgctggcatggctggtctcgatctaggcacaacttctcgctacgtccacaacgtcgatggtggcggcggcggacagttcaccaccgacaaccaccacgaagatgacggtggcgctggaggaaaccaccatcatcaccatcataatcataatcaccatcaaggtttagatttaatagcttctaatgataactctggactaggcggcggtggaggaggagggagcggtgacctcgtcatgcgtcggccacgtggccgtccagctggatcgaagaacaaaccgaagccgccggtgattgtcacgcgcgagagcgcaaacactcttagggctcacattcttgaagttggaagtggctgcgacgttttcgaatgtatctccacttacgctcgtcggagacagcgcgggatttgcgttttatccgggacgggaaccgtcactaacgtcagcatccgtcagcctacggcggccggagctgttgtgactctgcggggtacttttgagattctttccctctccggatcttttcttccgccacctgctcctccaggggcgactagcttgacgatattcctcgctggagctcaaggacaggtcgtcggaggtaacgtagttggtgagttaatggcggcggggccggtaatggtcatggcagcgtcttttacaaacgtggcttacgaaaggttgcctttggacgagcatgaggagcacttgcaaagtggcggcggcggaggtggagggaatatgtactcggaagccactggcggtggcggagggttgcctttctttaatttgccgatgagtatgcctcagattggagttgaaagttggcaggggaatcacgccggcgccggtagggctccgttttagcaatttaagaaactttaattgttttttccacttttttgtttttctccgaattttatgaaattatgatttaagaaaaaaaacgatattgttcatgtattgaccctcttactgcatggtttcttctattgggttaattggctagctcataagaattgtttaatttggttattgtcatcaaatttgcccacatataaagcttctagcaaat

SEQ ID NO: 56 - protein, 285 aa, Arabidopsis thaliana
MAGLDLGTTSRYVHNVDGGGGGQFTTDNHHEDDGGAGGNHHHHHHNHNHHQGLDLIASNDNSGLGGGGGGGSGDLVMRRPRGRPAGSKNKPKPPVIVTRESANTLRAHILEVGSGCDVFECISTYARRRQRGICVLSGTGTVTNVSIRQPTAAGAVVTLRGTFEILSLSGSFLPPPAPPGATSLTIFLAGAQGQVVGGNVVGELMAAGPVMVMAASFTNVAYERLPLDEHEEHLQSGGGGGGGNMYSEATGGGGGLPFFNLPMSMPQIGVESWQGNHAGAGRAPF

SEQ ID NO: 57 - DNA, 859 bp, Arabidopsis thaliana
caatccactaacgatccctaaccgaaaacagagtagtcaagaaacagagtattttttctacatggatccatttttaattcagtccccattctccggcttctcaccggaatattctatcggatcttctccagattctttctcatcctcttcttctaacaattactctcttcccttcaacgagaacgactcagaggaaatgtttctctacggtctaatcgagcagtccacgcaacaaacctatattgactcggatagtcaagaccttccgatcaaatccgtaagctcaagaaagtcagagaagtcttacagaggcgtaagacgacggccatgggggaaattcgcggcggagataagagattcgactagaaacggtattagggtttggctcgggacgttcgaaagcgcggaagaggcggctttagcctacgatcaagctgctttctcgatgagagggtcctcggcgattctcaatttttcggcggagagagttcaagagtcgctttcggagattaaatatacctacgaggatggttgttctccggttgtggcgttgaagaggaaacactcgatgagacggagaatgaccaataagaagacgaaagatagtgactttgatcaccgctccgtgaagttagataatgtagttgtctttgaggatttgggagaacagtaccttgaggagcttttggggtcttctgaaaatagtgggacttggtgaaagattaggatttgtattagggaccttaagtttgaagtggttgattaattttaaccctaatatgttttttgtttgcttaaatatttgattctattgagaaacatcgaaaacagtttgtatgtacttttgtgatacttggcg

SEQ ID NO: 58 - protein, 218 aa, Arabidopsis thaliana
MDPFLIQSPFSGFSPEYSIGSSPDSFSSSSSNNYSLPFNENDSEEMFLYGLIEQSTQQTYIDSDSQDLPIKSVSSRKSEKSYRGVRRRPWGKFAAEIRDSTRNGIRVWLGTFESAEEAALAYDQAAFSMRGSSAILNFSAERVQESLSEIKYTYEDGCSPVVALKRKHSMRRRMTNKKTKDSDFDHRSVKLDNVVVFEDLGEQYLEELLGSSENSGTW

SEQ ID NO: 59 - DNA, 800 bp, Arabidopsis thaliana
aagtataataacacaaagaaacagagtaaaagaaagaaaaatggattttaagaaggaagaaacacttcgtagagggccatggctcgaagaagaagacgaacggctagtgaaggtcattagtcttttgggagaacgtcgttgggattctttagcaatagtttccggtttgaagaggagtggtaagagttgcaggctaaggtggatgaactatctgaatccgactctgaagcgtggaccgatgagtcaagaagaagagagaatcatctttcagctccatgctctatggggtaacaagtggtcgaagattgcgagaagattacccggtaggactgataacgagataaagaactattggagaactcattatagaaagaaacaggaagctcaaaactatggaaagctctttgagtggagaggaaatacaggagaagaattgttgcacaagtataaggaaacagagatcactaggacaaagacgacgtctcaagaacatggttttgttgaagttgtgagcatggaaagtggtaaagaagccaacggtggtgttggtggaagagaaagcttcggtgttatgaaatcaccgtatgaaaatcggatttcggattggatatcagagatttctactgaccagagtgaagcaaatctttcagaagatcacagcagcaatagctgcagtgagaacaatattaacattggtacttggtggtttcaagagactagggactttgaggagttttcatgttctctatggtcataattctaaagttggtttatttactttttaaaaaaaaaaaaaaaaa

SEQ ID NO: 60 - protein, 238 aa, Arabidopsis thaliana
MDFKKEETLRRGPWLEEEDERLVKVISLLGERRWDSLAIVSGLKRSGKSCRLRWMNYLNPTLKRGPMSQEEERIIFQLHALWGNKWSKIARRLPGRTDNEIKNYWRTHYRKKQEAQNYGKLFEWRGNTGEELLHKYKETEITRTKTTSQEHGFVEVVSMESGKEANGGVGGRESFGVMKSPYENRISDWISEISTDQSEANLSEDHSSNSCSENNINIGTWWFQETRDFEEFSCSLWS

SEQ ID NO: 61 - DNA, 1041 bp, Arabidopsis thaliana
gttcttgtattggtttggatcggtatacttagttgattacgtaattaaatagatcggcgtgaagaagaaaaatgatcatgtgcagccgaggccattggagaccagctgaagacgagaagctcaaggatcttgtcgaacaatacggtcctcacaattggaacgccattgctctcaagcttcctggtcgctctggtaagagttgtagattgagatggtttaatcaattggatccaaggatcaaccgaaaccctttcacggaagaagaagaagaaagacttttagcggctcatcggatccatgggaacagatggtccatcatcgcaaggcttttccctggaagaactgataacgccgtcaagaaccattggcacgtcatcatggctcgtcgcacacgccaaacctctaagcctcgtcttcttccctcgacgacttcgtcttcttctttaatggcgagtgaacaaatcatgatgagttctggtggttataatcataattatagttccgatgatcggaagaaaatatttccagcagactttataaatttcccttacaaattctctcatatcaatcatcttcacttcctaaaggagtttttccccggaaagatcgctttaagtcacaaagcaaatcagagtaagaagcctatggagttctacaattttctacaagtaaacacagattcaaacaagagcgagattatagatcaagattcaggtcaaagcaaacgcagtgactcggacaccaaacatgaaagtcatgttccattcttcgactttttatccgttggaaactctgcctcctaggattagtttttttgcagtaactcctaaatttctagattaactatttagtccgtatacgtacgagattatctaggtcgttagcatgtatgcttgatgtgtataatcactaactagtgagctattacctgcgaaaattgtaagaaaaatacataatgttgatgtatcacacattctcaatgtctgtaaaatttccatcgagttgttaactatcaaagttatccgtttgaaaaaaaaaaaa

SEQ ID NO: 62 - protein, 243 aa, Arabidopsis thaliana
MIMCSRGHWRPAEDEKLKDLVEQYGPHNWNAIALKLPGRSGKSCRLRWFNQLDPRINRNPFTEEEEERLLAAHRIHGNRWSIIARLFPGRTDNAVKNHWHVIMARRTRQTSKPRLLPSTTSSSSLMASEQIMMSSGGYNHNYSSDDRKKIFPADFINFPYKFSHINHLHFLKEFFPGKIALSHKANQSKKPMEFYNFLQVNTDSNKSEIIDQDSGQSKRSDSDTKHESHVPFFDFLSVGNSAS

SEQ ID NO: 63 - DNA, 880 bp, Arabidopsis thaliana
cgacggtacggtggagatagagatagcatccatggagatgtctagaggaagcaacagttttgacaataagaagcctagttgccaaagaggtcactggagacctgttgaagatgacaatctccggcaactcgttgaacaatacggtcccaagaactggaattttattgctcaacatctctatggaagatcagggaaaagctgtagattaagatggtacaaccaacttgatccaaacatcaccaagaaacccttcaccgaggaggaagaagagagactgcttaaagctcatcggatccaagggaatcgttgggcctccatagcccgactgttccccgggaggaccgacaacgctgtcaaaaaccattttcatgtcatcatggctagacgcaaacgggaaaacttctcttccacagctacttctacgttcaaccaaacttggcatactgttttgagccctagttctagtcttacaaggctaaatagatcccatttcgggctatggaggtatcgaaaggataagagttgcggtctctggccttactcttttgtttcaccacctacgaatggtcaatttggatcttcatctgtctctaacgtacaccacgaaatttatcttgagaggagaaagtcgaaagagttggtggatcctcagaattacacatttcatgcagccacaccagatcataagatgacttcaaatgaagatggaccatccatgggagatgatggtgagaagaacgatgttactttcattgattttcttggtgttggattagcttcttaggttataacatcacaagtcaaagcttttaagggtttctatcattagggttaggcatcattttcagccttttgcttccttaaactctcatatggatct

SEQ ID NO: 64 - protein, 250 aa, Arabidopsis thaliana
MEMSRGSNSFDNKKPSCQRGHWRPVEDDNLRQLVEQYGPKNWNFIAQHLYGRSGKSCRLRWYNQLDPNITKKPFTEEEEERLLKAHRIQGNRWASIARLFPGRTDNAVKNHFHVIMARRKRENFSSTATSTFNQTWHTVLSPSSSLTRLNRSHFGLWRYRKDKSCGLWPYSFVSPPTNGQFGSSSVSNVHHEIYLERRKSKELVDPQNYTFHAATPDHKMTSNEDGPSMGDDGEKNDVTFIDFLGVGLAS

SEQ ID NO: 65 - DNA, 1964 bp, Arabidopsis thaliana
tccttccacaaaacttttttaattttatctgaaaaattaaaacaaccgaaacaaaaaaaaaaaactaaaaatcaaaaatctcatcaccttccttgctctgtattttttctctctcactaaatcctccatggatccttctctctctgcaaccaatgatcctcatcatcctcctcctcctcagttcacatctttccctcctttcaccaacaccaaccccttcgcctctccaaaccaccccttcttcaccggacccaccgccgtcgcgccgccaaacaacatccatctctatcaagcagctcctccgcagcagccacaaacatctccagttcctcctcatccatctatttcccaccctccttactctgacatgatttgcacggcgattgcagcgttaaacgaaccagatgggtcaagcaagcaagctatttcgaggtacatagagagaatttacactgggattcctactgctcatggagctttgttgacacaccatctcaagactttgaagaccagtgggattcttgtcatggttaagaaatcttacaagcttgcttctactcctcctcctcctcctcctactagtgtagctcctagtcttgaacctcccagatctgatttcatagtcaacgagaaccaacctttacctgatccggttttggcttcttctactcctcagactattaaacgtggtcgtggtcgacctccaaaagctaaaccagatgttgttcaacctcaacctctgactaatggaaaactcacctgggaacagagtgaattacctgtctctcgaccagaggagatacagatacagccgccacagttaccgttacagccacagcagccggttaagagaccgccgggtcgtcctagaaaagatggaacttcgccgacggtgaagccagctgcttctgtttccggtggtgtggagactgtgaaacgaagaggtagacctccgagtggaagagctgctgggagggagagaaagcctatagtagtctcagctccagcttcagtgttcccgtatgttgctaatggtggtgttagacgccgagggagaccaaagagagttgacgctggtggtgcttcctctgttgctccaccaccaccaccaccaactaacgtagagagtggaggagaggaggttgcagtcaagaaacgaggaagaggacggcctcctaagattggaggtgttatcaggaagcctatgaagccgatgagaagctttgctcgtactggaaaacccgtaggaagacccagaaagaatgcggtgtcagtgggagcttctggacgacaagatggtgactatggagaactgaagaagaagtttgagttgtttcaagcgagagctaaggatattgtaattgtgttgaaatccgagataggaggaagtggaaatcaagcagtggttcaagccatacaggacctggaagggatagcagagacaacaaacgagccaaagcacatggaagaagtgcagctgccagacgaggaacaccttgaaaccgaaccagaagcagagggtcaaggacagacagaagcagaggcaatgcaagaagctctgttctaaagataaagccttgacataaaaagctagcaagtggtgggtttacttgttgtgtgttacatgaaatttttaatcttataagggtgtttgcaggagaaaaacaaaaagaacaatgtgatgaactgatgatgatgattgtgtctctaaccaaacaacaaggagaggtagggtaatgtctgtaaagtgaattaggatgttaccattgttcatgcttcccatctctctccatcgtccatatctgtgtaggcagctttgttctttgttccctcgtgttttttttagactgttgtgtctcttattctattttgtctccttaggctttttaggagttgttgttgatgtttatcaaaaacgcttatgtaatttttatgaccacttctactttttatgatggtttctt

SEQ ID NO: 66 - protein, 479 aa, Arabidopsis thaliana
MDPSLSATNDPHHPPPPQFTSFPPFTNTNPFASPNHPFFTGPTAVAPPNNIHLYQAAPPQQPQTSPVPPHPSISHPPYSDMICTAIAALNEPDGSSKQAISRYIERIYTGIPTAHGALLTHHLKTLKTSGILVMVKKSYKLASTPPPPPPTSVAPSLEPPRSDFIVNENQPLPDPVLASSTPQTIKRGRGRPPKAKPDVVQPQPLTNGKLTWEQSELPVSRPEEIQIQPPQLPLQPQQPVKRPPGRPRKDGTSPTVKPAASVSGGVETVKRRGRPPSGRAAGRERKPIVVSAPASVFPYVANGGVRRRGRPKRVDAGGASSVAPPPPPPTNVESGGEEVAVKKRGRGRPPKIGGVIRKPMKPMRSFARTGKPVGRPRKNAVSVGASGRQDGDYGELKKKFELFQARAKDIVIVLKSEIGGSGNQAVVQAIQDLEGIAETTNEPKHMEEVQLPDEEHLETEPEAEGQGQTEAEAMQEALF

SEQ ID NO: 67 - DNA, 845 bp, Arabidopsis thaliana
aattttatttccttctctcaaatcttcccaccaaaaattaactctttcgttcacactaagtcccttttaaaagaaaatatcccaattaatggaacgtgacgactgccggagatttcaggactcgccggcgcagacgacggagagaagagtgaaatataaaccaaagaagaaaagagccaaagatgatgatgatgagaaagttgtttcgaagcatccaaattttcgaggtgtcagaatgagacaatggggaaaatgggtgtccgaaatcagagagccaaaaaagaaatcaagaatctggctcggtactttctccacggcggagatggcggcgcgtgctcacgacgtggcagctttagccatcaaaggcggttctgcacatctcaacttcccggagctcgcttatcacctccctagaccagctagtgccgaccctaaagacatccaagctgccgccgccgcagctgcagccgctgtggccattgacatggatgtagagacgtcttcgccgtcgccatctcccacagttacggaaacgtcatctccggctatgatagcactctccgacgacgcgttctccgatcttcctgatctcttgctcaacgtgaaccataacatcgatggcttctgggactcttttccctatgaagaacccttcctctctcaaagttactagaaactcaaaactatgtcgtttttgtatgtatttttgtcatgtgaccattttttgacgtcgaaaatcacccggataatccaaattgtatgatttattaatggttgatgattttctttgtgtggaacaatgtgtatgatacgtaatcaaaagttcaaaaaaaaaataaaaaaaa

SEQ ID NO: 68 - protein, 194 aa, Arabidopsis thaliana
MERDDCRRFQDSPAQTTERRVKYKPKKKRAKDDDDEKVVSKHPNFRGVRMRQWGKWVSEIREPKKKSRIWLGTFSTAEMAARAHDVAALAIKGGSAHLNFPELAYHLPRPASADPKDIQAAAAAAAAAVAIDMDVETSSPSPSPTVTETSSPAMIALSDDAFSDLPDLLLNVNHNIDGFWDSFPYEEPFLSQSY

SEQ ID NO: 69 - DNA, 1260 bp, Arabidopsis thaliana
gaaatttcatccctaaataagaaaaaagcatctccttctttagtgtcctccttcaccaaactcttgattccataagcatatattaaaaaagctctctgctttcttcaactttcccgggaaaatcttcttgttacaaagcatcaatctcttgttttaccaattttctctctttattccttttttgccctttacttttcctaactttggtctttatatataaacacacgacacaaagaagaacacacataagttaaaactattacaacagttttaaagagagagatttaaaaaatggagacagagaagaaagtttctctcccaagaatcttacgaatctctgttactgatccttacgcaacagattcgtcaagcgacgaagaagaagaagttgattttgatgcattatctacaaaacgacgtcgtgttaagaagtacgtgaaggaagtggtgcttgattcggtggtttctgataaagagaagccgatgaagaagaagagaaagaagcgcgttgttactgttccagtggttgttacgacggcgacgaggaagtttcgtggagtgaggcaaagaccgtggggaaaatgggcggcggagattagagatccgagtagacgtgttagggtttggttaggtacttttgacacggcggaggaagctgccattgtttacgataacgcagctattcagctacgtggtcctaacgcagagcttaacttccctcctcctccggtgacggagaatgttgaagaagcttcgacggaggtgaaaggagtttcggattttatcattggcggtggagaatgtcttcgttcgccggtttctgttctcgaatctccgttctccggcgagtctactgcggttaaagaggagtttgtcggtgtatcgacggcggagattgtggttaaaaaggagccgtcttttaacggttcagatttctcggcgccgttgttctcggacgacgacgtttttggtttctcgacgtcgatgagtgaaagtttcggcggcgatttatttggagataatctttttgcggatatgagttttggatccgggtttggattcgggtctgggtctggattctccagctggcacgttgaggaccattttcaagatattggggatttattcgggtcggatcctgtcttaactgtttaagaaataactggccgtttaacggcgtttagtgaagttttgttaccggcgacggcgaggattaaaaaaaaacggcgatttattttttgaatgaagatttgttaaata

SEQ ID NO: 70 - protein, 287 aa, Arabidopsis thaliana
METEKKVSLPRILRISVTDPYATDSSSDEEEEVDFDALSTKRRRVKKYVKEVVLDSVVSDKEKPMKKKRKKRVVTVPVVVTTATRKFRGVRQRPWGKWAAEIRDPSRRVRVWLGTFDTAEEAAIVYDNAAIQLRGPNAELNFPPPPVTENVEEASTEVKGVSDFIIGGGECLRSPVSVLESPFSGESTAVKEEFVGVSTAEIVVKKEPSFNGSDFSAPLFSDDDVFGFSTSMSESFGGDLFGDNLFADMSFGSGFGFGSGSGFSSWHVEDHFQDIGDLFGSDPVLTV

SEQ ID NO: 71 - DNA, 983 bp, Arabidopsis thaliana
cgtcgacgcgaaataaatcctagaaaataactatcaatatgatgaaggttgatcaagattattcgtgtagtataccgcctggatttaggtttcatccgacagatgaagaacttgtcggatattatctcaagaagaaaatcgcctcccagaggattgatctcgacgttatcagagaaattgatctttacaagatcgaaccatgggatctacaagagagatgtaggatagggtacgaggagcaaacggagtggtatttcttcagccatagagacaagaagtatccgactgggactaggacaaaccgagccaccgtggccggtttctggaaagcaacgggccgggacaaggcggtttacctcaactccaaacttatcggtatgagaaaaacgcttgtcttttaccgaggtcgagcgcctaatggccaaaagtccgattggatcattcacgaatactacagcctcgagtcacaccagaactctcctccacaggaagaaggatgggtagtgtgtagagcatttaagaaacgaacgaccatcccaacaaaaaggaggcaactttgggatccgaactgcttattctacgacgacgccactctcttggaacctctcgacaagcgagccagacataatcctgattttaccgccacaccgttcaagcaagaactactctccgaggccagtcacgtccaggatggagatttcggatctatgtaccttcaatgcatcgatgatgatcaattctcccagcttcctcagctcgagagcccctctcttccgtcggaaataactccccatagtactactttttctgagaacagtagccggaaagatgacatgagctccgagaagaggatcactgactggagatatctagataagttcgtggcgtctcaatttttgatgagtggagaagactaaaaaaggctttcctatgcatgcatgcactagaaacgtcgtcgcattttggatttacatgcggccgct

SEQ ID NO: 72 - protein, 292 aa, Arabidopsis thaliana
MMKVDQDYSCSIPPGFRFHPTDEELVGYYLKKKIASQRIDLDVIREIDLYKIEPWDLQERCRIGYEEQTEWYFFSHRDKKYPTGTRTNRATVAGFWKATGRDKAVYLNSKLIGMRKTLVFYRGRAPNGQKSDWIIHEYYSLESHQNSPPQEEGWVVCRAFKKRTTIPTKRRQLWDPNCLFYDDATLLEPLDKRARHNPDFTATPFKQELLSEASHVQDGDFGSMYLQCIDDDQFSQLPQLESPSLPSEITPHSTTFSENSSRKDDMSSEKRITDWRYLDKFVASQFLMSGED

SEQ ID NO: 73 - DNA, 1440 bp, Arabidopsis thaliana
atcctttcaatttccactcctctctaatataattcacattttcccactattgctgattcatttttttttgtgaattatttcaaacccacataaaaaaatctttgtttaaatttaaaaccatggatccttcatttaggttcattaaagaggagtttcctgctggattcagtgattctccatcaccaccatcttcttcttcatacctttattcatcttccatggctgaagcagccataaatgatccaacaacattgagctatccacaaccattagaaggtctccatgaatcagggccacctccatttttgacaaagacatatgacttggtggaagattcaagaaccaatcatgtcgtgtcttggagcaaatccaataacagcttcattgtctgggatccacaggccttttctgtaactctccttcccagattcttcaagcacaataacttctccagttttgtccgccagctcaacacatatggtttcagaaaggtgaatccggatcggtgggagtttgcaaacgaagggtttcttagagggcaaaagcatctcctcaagaacataaggagaagaaaaacaagtaataatagtaatcaaatgcaacaacctcaaagttctgaacaacaatctctagacaatttttgcatagaagtgggtaggtacggtctagatggagagatggacagcctaaggcgagacaagcaagtgttgatgatggagctagtgagactaagacagcaacaacaaagcaccaaaatgtatctcacattgattgaagagaagctcaagaagaccgagtcaaaacaaaaacaaatgatgagcttccttgcccgcgcaatgcagaatccagattttattcagcagctagtagagcagaaggaaaagaggaaagagatcgaagaggcgatcagcaagaagagacaaagaccgatcgatcaaggaaaaagaaatgtggaagattatggtgatgaaagtggttatgggaatgatgttgcagcctcatcctcagcattgattggtatgagtcaggaatatacatatggaaacatgtctgaattcgagatgtcggagttggacaaacttgctatgcacattcaaggacttggagataattccagtgctagggaagaagtcttgaatgtggaaaaaggaaatgatgaggaagaagtagaagatcaacaacaagggtaccataaggagaacaatgagatttatggtgaaggtttttgggaagatttgttaaatgaaggtcaaaattttgattttgaaggagatcaagaaaatgttgatgtgttaattcagcaacttggttatttgggttctagttcacacactaattaagaagaaattgaaatgatgactactttaagcatttgaatcaacttgtttcctattagtaatttggctttgtttcaatcaagtgagtcgtggactaacttgc

SEQ ID NO: 74 - protein, 406 aa, Arabidopsis thaliana
MDPSFRFIKEEFPAGFSDSPSPPSSSSYLYSSSMAEAAINDPTTLSYPQPLEGLHESGPPPFLTKTYDLVEDSRTNHVVSWSKSNNSFIVWDPQAFSVTLLPRFFKHNNFSSFVRQLNTYGFRKVNPDRWEFANEGFLRGQKHLLKNIRRRKTSNNSNQMQQPQSSEQQSLDNFCIEVGRYGLDGEMDSLRRDKQVLMMELVRLRQQQQSTKMYLTLIEEKLKKTESKQKQMMSFLARAMQNPDFIQQLVEQKEKRKEIEEAISKKRQRPIDQGKRNVEDYGDESGYGNDVAASSSALIGMSQEYTYGNMSEFEMSELDKLAMHIQGLGDNSSAREEVLNVEKGNDEEEVEDQQQGYHKENNEIYGEGFWEDLLNEGQNFDFEGDQENVDVLIQQLGYLGSSSHTN

SEQ ID NO: 75 - DNA, 984 bp, Arabidopsis thaliana
atggatggaatgtacaatttccattcggccggtgattattcagataagtcggttctgatgatgtcaccggagagtctcatgtttccttccgattaccaagctttgctatgttcctccgccggtgaaaatcgtgtctctgatgttttcggatccgacgagctactctcagtagccgtctccgctttgtcgtcggaggcggcttcgatcgctccggagatccgaagaaatgatgataacgtttctctaactgtcatcaaagctaaaatcgcttgtcatccttcgtatcctcgcttacttcaagcttacatcgattgccaaaaggtcggagcaccaccggagatagcgtgtttactagaggagattcaacgggagagtgatgtttataagcaagaggttgttccttcttcttgctttggagctgatcctgagcttgatgaatttatggaaacgtactgcgatatattagtgaaatacaaatcggatctagcaagaccgtttgacgaggcaacgtgtttcttgaacaagattgagatgcagctacggaacctatgtactggtgtcgagtctgccaggggagtttctgaggatggtgtaatatcatctgacgaggaactgagtggaggtgatcatgaggtagcagaggatgggagacaaagatgtgaagaccgggacctcaaagataggttgctacgcaaatttggaagccgtattagtactttaaagcttgagttctcaaagaagaagaagaaaggaaagttaccaagagaagcaagacaagctcttcttgattggtggaatctccattataagtggccttaccctactgaaggagataagatagcattagctgatgcaacggggttagaccaaaaacaaatcaacaattggtttataaaccaaaggaaacgtcattggaagccatcagagaatatgcctttcgctatgatggatgattctagtggatcattctttaccgaggaatga

SEQ ID NO: 76 - protein, 327 aa, Arabidopsis thaliana
MDGMYNFHSAGDYSDKSVLMMSPESLMFPSDYQALLCSSAGENRVSDVFGSDELLSVAVSALSSEAASIAPEIRRNDDNVSLTVIKAKIACHPSYPRLLQAYIDCQKVGAPPEIACLLEEIQRESDVYKQEVVPSSCFGADPELDEFMETYCDILVKYKSDLARPFDEATCFLNKIEMQLRNLCTGVESARGVSEDGVISSDEELSGGDHEVAEDGRQRCEDRDLKDRLLRKFGSRISTLKLEFSKKKKKGKLPREARQALLDWWNLHYKWPYPTEGDKIALADATGLDQKQINNWFINQRKRHWKPSENMPFAMMDDSSGSFFTEE

SEQ ID NO: 77 - DNA, 1136 bp, Arabidopsis thaliana
cccttttcctctctttctccaaatctctgaaaattttcaccagaatctctgttctttttttcaccagaatctctctgtttaaaataataggtgatgatgatggatgagtttatggatcttagaccagtgaagtacacagagcacaagactgttatcagaaagtacactaaaaagtcgtctatggagaggaagaccagtgttcgtgactcggccaggttggttcgggtctcaatgacggatcgtgacgccactgattcatcaagcgacgaggaagagtttctgttccctcgaagacgtgtcaagagattgattaacgagatcagagtcgagcctagcagctcttccaccggcgacgtctctgcttctccgacgaaggaccggaaaagaatcaacgttgattctacggttcaaaagccctctgtttccggccaaaaccagaagaagtaccgcggcgtgagacagcgaccatggggaaaatgggcggcggagattcgtgatcctgagcaacgccggagaatctggctcggtacttttgcaacggcggaggaagctgccatcgtctacgacaacgcagcaatcaaacttcgtggccctgatgctcttaccaacttcaccgtacaaccagaaccagaaccggtacaagaacaagaacaagaaccggagagcaacatgtcggtttcgatatcagaatcaatggacgattctcaacatctatcatctccgacatcggttctcaactaccaaacatatgtctcggaggaaccaatcgatagtcttatcaaaccggttaaacaagagtttcttgaaccagaacaagagccaataagctggcatcttggagaaggtaatactaatactaatgatgattcatttccattggacattacatttctcgacaactatttcaatgaatcattaccagacatctccatcttcgatcaacctatgtctcctattcaaccaacagagaatgatttcttcaacgaccttatgttattcgatagcaacgcagaagaatactactcctccgagatcaaagagattggttcatcgttcaacgatcttgatgattctttgatatccgatctcttacttgtgtgatatttttgccattaaccaaacaccggtttggttgc

SEQ ID NO: 78 - protein, 335 aa, Arabidopsis thaliana
MMMDEFMDLRPVKYTEHKTVIRKYTKKSSMERKTSVRDSARLVRVSMTDRDATDSSSDEEEFLFPRRRVKRLINEIRVEPSSSSTGDVSASPTKDRKRINVDSTVQKPSVSGQNQKKYRGVRQRPWGKWAAEIRDPEQRRRIWLGTFATAEEAAIVYDNAAIKLRGPDALTNFTVQPEPEPVQEQEQEPESNMSVSISESMDDSQHLSSPTSVLNYQTYVSEEPIDSLIKPVKQEFLEPEQEPISWHLGEGNTNTNDDSFPLDITFLDNYFNESLPDISIFDQPMSPIQPTENDFFNDLMLFDSNAEEYYSSEIKEIGSSFNDLDDSLISDLLLV

SEQ ID NO: 79 - DNA, 1076 bp, Arabidopsis thaliana
acaactattctctcctctctctttttttattaaaaaagctcaaatttatataggttttttgttcacaaaatggattataaccttccaattccattagagggtctcaaagaaacgccaccaacggctttcttgacgaaaacatacaacatagtggaggattcaagcacaaacaacatagtttcatggagcagagacaacaacagcttcattgtttgggaaccagagacttttgccctaatttgcctccctagatgctttaagcacaataatttctccagctttgttagacagctcaatacttatgggtttaagaagattgatacagagagatgggaatttgcaaatgagcattttctgaagggagagaggcatcttcttaagaacatcaagagaagaaagacatcatctcaaacgcaaacgcagtcgctagaaggagagatccatgagctgcgaagagacagaatggctttagaagtagaactggttagactgcgacgaaaacaagaaagcgtgaagacatatctgcatttgatggaagagaaactgaaagtcacagaagtaaagcaagaaatgatgatgaatttcttgctaaagaagattaagaaaccgagttttttacagagcttaaggaaacgtaatctgcaaggaatcaagaatcgagagcaaaagcaagaggtgatctcaagccatggtgttgaggataatggaaagtttgttaaagctgagccagaagagtatggtgatgacatcgatgatcaatgtggaggtgtgtttgattatggtgatgagcttcacatagcttcaatggagcatcaaggacaaggggaggatgaaattgaaatggatagtgaaggaatttggaagggtttcgtgttgagtgaggaggagatgtgtgatttagtggaacattttatataataaactaatgtattatgagaggtttttttttgtttttttgctttttttttccgagtttgtcatcaagcattgtatacaatttgggccaaactaaaagcccaacaaaatatttggccttggcatttgttaacaaattgactaattcggccacaccttcc

SEQ ID NO: 80 - protein, 282 aa, Arabidopsis thaliana
MDYNLPIPLEGLKETPPTAFLTKTYNIVEDSSTNNIVSWSRDNNSFIVWEPETFALICLPRCFKHNNFSSFVRQLNTYGFKKIDTERWEFANEHFLKGERHLLKNIKRRKTSSQTQTQSLEGEIHELRRDRMALEVELVRLRRKQESVKTYLHLMEEKLKVTEVKQEMMMNFLLKKIKKPSFLQSLRKRNLQGIKNREQKQEVISSHGVEDNGKFVKAEPEEYGDDIDDQCGGVFDYGDELHIASMEHQGQGEDEIEMDSEGIWKGFVLSEEEMCDLVEHFI

SEQ ID NO: 81 - DNA, 1677 bp, Arabidopsis thaliana
aatgtcggttgtacaattatttgtcactaaagtttccaaatttcttctaaactgatgaatcaatggaacatgatgacgaaaaagataaatccacggtggcgggaactgacccacccatttccaccgcctctctattccccagatttttttcaattatctgactacagtttgtcggttacttccttccctaaacctttataaaccattaaacctctcatccttcttctcttaaaccccctaattatcacacacaccccaatttctcactctctctctcactaaaacccgtaaattttctactatatcaaatgagcccaaaaaaagatgctgtttctaaaccaactccaatttcagtacccgtttcgagacgatccgatatacccgggtctctctacgtcgacactgacatgggtttctctgggtcaccacttcccatgccactagacatcttacaagggaatccaattccaccttttttatccaagacttttgatttggttgatgacccgactcttgacccggtcatctcttggggactgaccggagctagcttcgtagtttgggatcctctagagtttgccagaatcatacttccaaggaatttcaaacacaacaatttctccagcttcgtcagacagcttaacacttatggatttcgaaagattgatactgacaagtgggaattcgctaacgaggctttccttagaggcaagaagcatcttctgaagaacattcatcgtcgtcgatcaccacaatccaaccaaacttgctgcagtagcactagccaaagccaagggtcacctactgaggttggaggagagattgagaagctgaggaaagagcggcgtgcattgatggaggaaatggttgagcttcagcagcaaagcagaggcacagctcgacatgtggacactgtaaaccagaggctgaaagctgcagagcaacgtcagaagcaattgctctctttcttggctaagttgtttcagaaccggggtttcttggaacgcctgaagaacttcaaaggaaaagaaaaaggaggagctcttggattggaaaaggcgagaaagaagttcatcaagcaccaccagcagcctcaagattctccaacaggaggggaggtggtgaagtatgaagctgatgattgggagagattgctaatgtatgacgaagagactgagaacaccaagggtttaggagggatgacttcaagcgatccaaaaggcaagaacttgatgtatccatcagaagaagagatgagcaaaccagattacttgatgtccttcccatctcctgaaggacttattaaacaagaagagacgacatggagcatgggtttcgatactacaataccgagtttcagcaacaccgatgcatggggaaacacaatggactataatgatgtctcagagtttggttttgctgcagaaacaacaagtgatggtttgcctgatgtctgctgggaacaatttgctgcaggaatcacagagactggattcaactggccaactggtgatgatgatgataatacgccaatgaatgatccttaggatcttttcatatatagtttagaccaaaaacccgtttcttatcgggtgaactattaattcattattcattttgaatgcactctttatacatatatataatattgatgagtttgattgttccaaaaaaaaa

SEQ ID NO: 82 - protein, 412 aa, Arabidopsis thaliana
MSPKKDAVSKPTPISVPVSRRSDIPGSLYVDTDMGFSGSPLPMPLDILQGNPIPPFLSKTFDLVDDPTLDPVISWGLTGASFVVWDPLEFARIILPRNFKHNNFSSFVRQLNTYGFRKIDTDKWEFANEAFLRGKKHLLKNIHRRRSPQSNQTCCSSTSQSQGSPTEVGGEIEKLRKERRALMEEMVELQQQSRGTARHVDTVNQRLKAAEQRQKQLLSFLAKLFQNRGFLERLKNFKGKEKGGALGLEKARKKFIKHHQQPQDSPTGGEVVKYEADDWERLLMYDEETENTKGLGGMTSSDPKGKNLMYPSEEEMSKPDYLMSFPSPEGLIKQEETTWSMGFDTTIPSFSNTDAWGNTMDYNDVSEFGFAAETTSDGLPDVCWEQFAAGITETGFNWPTGDDDDNTPMNDP

SEQ ID NO: 83 - DNA, 450 bp, Arabidopsis thaliana
atgctagatcccaccgagaaagtaatcgattcagaatcaatggaaagcaaactcacatcagtagatgcgatcgaagaacacagcagcagtagcagtaatgaagctatcagcaacgagaagaagagttgtgccatttgtggtaccagcaaaacccctctttggcgaggcggtcctgccggtcccaagtcgctttgtaacgcatgcgggatcagaaacagaaagaaaagaagaacactgatctcaaatagatcagaagataagaagaagaagagtcataacagaaacccgaagtttggtgactcgttgaagcagcgattaatggaattggggagagaagtgatgatgcagcgatcaacggctgagaatcaacggcggaataagcttggcgaagaagagcaagccgccgtgttactcatggctctctcttatgcttcttccgtttatgcttaa

SEQ ID NO: 84 - protein, 149 aa, Arabidopsis thaliana
MLDPTEKVIDSESMESKLTSVDAIEEHSSSSSNEAISNEKKSCAICGTSKTPLWRGGPAGPKSLCNACGIRNRKKRRTLISNRSEDKKKKSHNRNPKFGDSLKQRLMELGREVMMQRSTAENQRRNKLGEEEQAAVLLMALSYASSVYA

SEQ ID NO: 85 - DNA, 640 bp, Arabidopsis thaliana
ataacaaactcatcaaacttcctcagcgtttctttttcttacataaacaatttttcttacataaacaaatcttgttgtttgttgttgtcatggcaccgacagttaaaacggcggccgtcaaaaccaacgaaggtaacggagtccgttacagaggagtgaggaagagaccatggggacgttacgcagccgagatcagagatcctttcaagaagtcacgtgtctggctcggtactttcgacactcctgaagaagccgctcgtgcctacgacaaacgtgctattgagtttcgtggagctaaagccaaaaccaacttcccttgttacaacatcaacgcccactgcttgagtttgacacagagcctgagccagagcagcaccgtggaatcatcgtttcctaatctcaacctcggatctgactctgttagttcgagattcccttttcctaagattcaggttaaggctgggatgatggtgttcgatgaaaggagtgaatcggattcttcgtcggtggtgatggatgtcgttagatatgaaggacgacgtgtggttttggacttggatcttaatttccctcctccacctgagaactgattaagatttaattatgattattagatataattaaatgtttctgaattgag

SEQ ID NO: 86 - protein, 166 aa, Arabidopsis thaliana
MAPTVKTAAVKTNEGNGVRYRGVRKRPWGRYAAEIRDPFKKSRVWLGTFDTPEEAARAYDKRAIEFRGAKAKTNFPCYNINAHCLSLTQSLSQSSTVESSFPNLNLGSDSVSSRFPFPKIQVKAGMMVFDERSESDSSSVVMDVVRYEGRRVVLDLDLNFPPPPEN

SEQ ID NO: 87 - DNA, 765 bp, Arabidopsis thaliana
aatcactctacaaagcctgtacgtacacaacaacattaccatggtgaaacaagaacgcaagatccaaaccagcagcacaaaaaaggaaatgcctttgtcatcatcaccatcttcttcttcttcttcatcttcttcctcgtcttcgtcttcgtgtaagaacaagaacaagaagagtaagattaagaagtacaaaggagtgaggatgagaagttggggatcatgggtctctgagattagggcaccaaatcaaaagacaaggatttggttaggttcttactcaacagctgaagcagctgctagagcttacgatgttgcactcttatgtctcaaaggccctcaagccaatctcaacttccctacttcttcttcttctcatcatcttcttgataatctcttagatgaaaatacccttttgtcccccaaatccatccaaagagtagctgctcaagctgccaactcatttaaccattttgcccctacttcatcagccgtctcgtcaccgtccgatcatgatcatcaccatgatgatgggatgcaatctttgatgggatcttttgtggacaatcatgtgtctttgatggattcaacatcttcatggtatgatgatcataatgggatgttcttgtttgataatggagctccattcaattactctcctcaactaaactcgacgacgatgctcgatgaatacttctacgaagatgctgacattccgctttggagtttcaattaatccgacggtccataatacatactttaattagt

SEQ ID NO: 88 - protein, 230 aa, Arabidopsis thaliana
MVKQERKIQTSSTKKEMPLSSSPSSSSSSSSSSSSSSCKNKNKKSKIKKYKGVRMRSWGSWVSEIRAPNQKTRIWLGSYSTAEAAARAYDVALLCLKGPQANLNFPTSSSSHHLLDNLLDENTLLSPKSIQRVAAQAANSFNHFAPTSSAVSSPSDHDHHHDDGMQSLMGSFVDNHVSLMDSTSSWYDDHNGMFLFDNGAPFNYSPQLNSTTMLDEYFYEDADIPLWSFN

SEQ ID NO: 89 - DNA, 1019 bp, Arabidopsis thaliana
cctctcttcattttttaactccctctctctctctctctctatggagagacgaacgagacgagtgaagttcacagagaatcgtacggtcacaaacgtagcagctacaccatctaacgggtctccgagactggtccgtatcactgttactgatcctttcgctactgactcgtctagcgacgacgacgacaacaacaacgtcacggtggttccaagagtgaaacgatacgtgaaggagattagattctgccaaggtgaatcttcttcctccaccgcggcgaggaaaggtaagcacaaggaggaggaaagcgtagtggttgaagatgacgtgtcgacgtcggtgaagcctaaaaagtacagaggcgtgagacagagaccttggggaaaattcgcggcggagattagagatccgtcgagccgtactcggatttggcttgggacttttgtcacggcggaggaagctgctatagcgtacgatagagccgcgattcatctcaaaggacctaaagcgctcacgaatttcctaactccgccgacgccaacgccggttatcgatctccaaacggtttccgcctgcgattacggtagagattctcggcagagccttcattcaccgacctctgttctaagattcaacgtcaacgaggaaacagagcatgagattgaagcgatcgagctatctccggagagaaagtcgacggttataaaagaagaagaagaatcgtcggcgggtttggtgttcccggatccgtatctgttaccggatttatctctcgccggcgaatgtttttgggataccgaaattgcccctgaccttttgtttctcgatgaagaaaccaaaatccaatcaacgttgttaccaaacacagaggtttcgaaacaaggagaaaacgaaactgaagatttcgagtttggtttgattgatgatttcgagtcttctccatgggatgtggatcatttcttcgaccatcatcatcactctttcgattaaaaatctcttcttttttggggaaatttttgtg

SEQ ID NO: 90 - protein, 315 aa, Arabidopsis thaliana
MERRTRRVKFTENRTVTNVAATPSNGSPRLVRITVTDPFATDSSSDDDDNNNVTVVPRVKRYVKEIRFCQGESSSSTAARKGKHKEEESVVVEDDVSTSVKPKKYRGVRQRPWGKFAAEIRDPSSRTRIWLGTFVTAEEAAIAYDRAAIHLKGPKALTNFLTPPTPTPVIDLQTVSACDYGRDSRQSLHSPTSVLRFNVNEETEHEIEAIELSPERKSTVIKEEEESSAGLVFPDPYLLPDLSLAGECFWDTEIAPDLLFLDEETKIQSTLLPNTEVSKQGENETEDFEFGLIDDFESSPWDVDHFFDHHHHSFD

SEQ ID NO: 91 - DNA, 1366 bp, Arabidopsis thaliana
ctgtgattgtcaagagtttgaacacacaaagaagaaagaagaactcaacatttcaagcaagaagaaagagagaagagagaaggtccaataatagagagaacaaaaaaaaagagagcttaattgtcagtttattctctgcaaacgtgcggcctaagtaacacatgtcgaattatggagttaaagagctcacatgggaaaatgggcaactaaccgttcatggtctaggcgacgaagtagaaccaaccacctcgaataaccctatttggactcaaagtctcaacggttgtgagactttggagtctgtggttcatcaagcggctctacagcagccaagcaagtttcagctgcagagtccgaatggtccaaaccacaattatgagagcaaggatggatcttgttcaagaaaacgcggttatcctcaagaaatggaccgatggttcgctgttcaagaggagagccatagagttggccacagcgtcactgcaagtgcgagtggtaccaatatgtcttgggcgtcttttgaatccggtcggagcttgaagacagctagaaccggagacagagactatttccgctctggatcggaaactcaagatactgaaggagatgaacaagagacaagaggagaagcaggtagatctaatggacgacggggacgagcagcagcgattcacaacgagtccgaaaggagacggcgtgataggataaaccagaggatgagaacacttcagaagctgcttcctactgcaagtaaggcggataaagtctcaatcttggatgatgttatcgaacacttgaaacagctacaagcacaagtacagttcatgagcctaagagccaacttgccacaacaaatgatgattccgcaactacctccaccacagtcagttctcagcatccaacaccaacaacaacaacaacaacagcagcagcagcagcaacaacagcagcaacagtttcagatgtcgttgcttgcaacaatggcaagaatgggaatgggaggtggtggaaatggttatggaggtttagttcctcctcctcctcctccaccaatgatggtccctcctatgggtaacagagactgcaccaacggttcttcagccacattatctgatccatacagcgcctttttcgcacagacaatgaatatggatctctacaataaaatggcagcagctatctatagacaacagtctgatcaaacaacaaaggtaaatatcggcatgccttcaagttcttcgaatcatgagaaaagagattagtctagcgacctagtattattgatccatatatatagttcttgaaagattgttgtatcatgattgtaaaaactgttttgagtatggaaaaagacttgcagataaaa

SEQ ID NO: 92 - protein, 366 aa, Arabidopsis thaliana
MSNYGVKELTWENGQLTVHGLGDEVEPTTSNNPIWTQSLNGCETLESVVHQAALQQPSKFQLQSPNGPNHNYESKDGSCSRKRGYPQEMDRWFAVQEESHRVGHSVTASASGTNMSWASFESGRSLKTARTGDRDYFRSGSETQDTEGDEQETRGEAGRSNGRRGRAAAIHNESERRRRDRINQRMRTLQKLLPTASKADKVSILDDVIEHLKQLQAQVQFMSLRANLPQQMMIPQLPPPQSVLSIQHQQQQQQQQQQQQQQQQQFQMSLLATMARMGMGGGGNGYGGLVPPPPPPPMMVPPMGNRDCTNGSSATLSDPYSAFFAQTMNMDLYNKMAAAIYRQQSDQTTKVNIGMPSSSSNHEKRD

SEQ ID NO: 93 - DNA, 1361 bp, Arabidopsis thaliana
ttttttttccctttcctcgttcaaaaaaagtacttgcagagtcactcactctcagtctcagcacatgaattaatttgaagcttccctagaattctttcacatcaattaatacgacaccgtctcgggtgaagaatctctcctctcttgccctaaagcgagttagggtttaacacacaaagcataccctttagatttgtgtctcttagctctgtttttgtcggcttgtgtaaccgatcaactcaagctattggctcctcacctcctgaaatttgacttctccaatggatctcaaagtttctcttatatgaattctatcttcaccctcacaatatctttatatatatgagccacaagaacaagaagagtcagtagatgcggctgccatggacggtggttacgatcaatccggaggagcttctagatactttcacaacctcttcaggcctgagcttcatcaccagcttcaacctcagcctcaacttcaccctttgcctcagcctcagcctcaacctcagcctcagcagcagaattcagatgatgaatctgactccaacaaggatccgggttccgacccagttacctctggttcaaccgggaaacgtccacgtggacgtcctccgggatccaagaacaagccgaagccaccggtgatagtgactagagatagccccaacgtgcttagatctcatgttcttgaagtctcatctggagccgacatagtcgagagcgttaccacttacgctcgcaggagaggaagaggagtctccattctcagtggtaacggcacggtggctaacgtcagtctccggcagccggcaacgacagcggctcatggggcaaatggtggaaccggaggtgttgtggctctacatggaaggtttgagatactttccctcacaggtacggtgttgccgccccctgcgccgccaggatccggtggtctttctatctttctttccggcgttcaaggtcaggtgattggaggaaacgtggtggctccgcttgtggcttcgggtccagtgatactaatggctgcatcgttctctaatgcaactttcgaaaggcttccccttgaagatgaaggaggagaaggtggagagggaggagaagttggagagggaggaggaggagaaggtggtccaccgccggccacgtcatcatcaccaccatctggagccggtcaaggacagttaagaggtaacatgagtggttatgatcagtttgccggtgatcctcatttgcttggttggggagccgcagccgcagccgcaccaccaagaccagccttttagaattgaaaattatgtccgtaacatagctgtaaccaaatttcatttctcaaaattaaaagaaaaaaaaaa

SEQ ID NO: 94 - protein, 302 aa, Arabidopsis thaliana
MDGGYDQSGGASRYFHNLFRPELHHQLQPQPQLHPLPQPQPQPQPQQQNSDDESDSNKDPGSDPVTSGSTGKRPRGRPPGSKNKPKPPVIVTRDSPNVLRSHVLEVSSGADIVESVTTYARRRGRGVSILSGNGTVANVSLRQPATTAAHGANGGTGGVVALHGRFEILSLTGTVLPPPAPPGSGGLSIFLSGVQGQVIGGNVVAPLVASGPVILMAASFSNATFERLPLEDEGGEGGEGGEVGEGGGGEGGPPPATSSSPPSGAGQGQLRGNMSGYDQFAGDPHLLGWGAAAAAAPPRPAF

SEQ ID NO: 95 - DNA, 687 bp, Arabidopsis thaliana
tcctcccttaattagtatcaaaaatggtgaaaacacttcaaaagacaccaaagagaatgtcatctccatcatcatcatcttcatcatcctcatcaacatcatcatcatccataaggatgaagaagtacaagggagtgagaatgagaagttggggttcatgggtttcagagatcagagctcctaatcaaaagacaaggatctggcttggttcttactcaactgctgaagccgcggctagagcctacgacgcagcactcctatgtcttaaaggatcctcagctaataatctcaacttcccagagatctcaacttctctctaccatattatcaacaatggtgataacaacaatgacatgtcccctaagtctatacaaagagtagcagctgcagctgctgctgccaacacagatccttcctcatcatcagtctctacttcatctccattgctttcctctccatctgaagatctctatgatgttgtctccatgtcacagtatgaccaacaagtctccttgtctgaatcatcatcatggtacaactgctttgatggtgatgatcagttcatgttcattaatggagtctccgcgccgtatttgacaacatcactttctgatgatttctttgaggaaggagatatcagattatggaacttctgctgattctactttcattataccttattctttg

SEQ ID NO: 96 - protein, 211 aa, Arabidopsis thaliana
MVKTLQKTPKRMSSPSSSSSSSSSTSSSSIRMKKYKGVRMRSWGSWVSEIRAPNQKTRIWLGSYSTAEAAARAYDAALLCLKGSSANNLNFPEISTSLYHIINNGDNNNDMSPKSIQRVAAAAAAANTDPSSSSVSTSSPLLSSPSEDLYDVVSMSQYDQQVSLSESSSWYNCFDGDDQFMFINGVSAPYLTTSLSDDFFEEGDIRLWNFC

SEQ ID NO: 97 - DNA, 867 bp, Arabidopsis thaliana
ataacaaactctttaatgtcaccacagagaatgaagctatcatcaccaccagttaccaacaacgaaccaaccgccaccgcttctgccgttaaatcttgcggcggaggaggtaaagaaaccagctcatcgaccacgaggcatccagtgtaccacggagttcgcaaacgccgatggggaaaatgggtttctgagatcagagagccccggaaaaagtctcggatttggctcggatcttttccggtgccggagatggctgctaaggcctacgacgtggcagcgttttgtctaaaaggtagaaaagctcagctgaatttccctgaagaaatcgaggatctacctcgaccgtccacgtgtactcccagagatatccaagtcgcagcggccaaagcagccaacgccgtgaagatcatcaaaatgggagatgatgacgtggcaggaatagacgacggagatgatttctgggaaggcattgagctgcctgagcttatgatgagtggaggtgggtggtcgccggagccttttgttgccggagatgatgccacgtggcttgtcgacggagacttgtatcagtatcagttcatggcgtgtctgtgagtgttgctgtcgattgtgtcgtattcgttatacgtgtacgttgtatcgttattgtgttggctcacttaatttaatgcatatgcatgtatattttcatttatttgtttctagtttattgttttacgcgattaataattagatacctgtttctcaagttagttatcaggtttgtacgcatctacaaaaatacgtataagtgtatgttcttatatacagtttttgtttgcataagtattgctacttattctaaaaaaaaaaaaaaaaaaaaaaaaa

SEQ ID NO: 98 - protein, 192 aa, Arabidopsis thaliana
MSPQRMKLSSPPVTNNEPTATASAVKSCGGGGKETSSSTTRHPVYHGVRKRRWGKWVSEIREPRKKSRIWLGSFPVPEMAAKAYDVAAFCLKGRKAQLNFPEEIEDLPRPSTCTPRDIQVAAAKAANAVKIIKMGDDDVAGIDDGDDFWEGIELPELMMSGGGWSPEPFVAGDDATWLVDGDLYQYQFMACL

SEQ ID NO: 99 - DNA, 1140 bp, Arabidopsis thaliana
aaatcataaaagcctctctcttagtctatttttatctcacggctctctctcccctctctacacacacaaacacaaataaagcgtaaaactgaaatattttaattacaattagaaagagaacatattaatatgtcaaatataacaaagaagaagtgtaatggaaatgaagagggtgcagagcagaggaaagggccttggacactcgaggaagacactcttctcaccaattacatttcccataacggtgaaggccgatggaatctgctcgctaaatcttctgggctaaagagagcaggaaaaagttgtagattgagatggttgaattaccttaaacccgacataaagcgtgggaatctcactcctcaagaacaacttttaatccttgagctccattctaaatggggtaataggtggtcaaaaatttcgaagtatttaccaggaagaacagacaacgatatcaaaaactactggagaactagagtccagaaacaagcacgccagctcaacatagattccaatagccacaagttcatagaagttgttcgtagcttttggtttccaagactgatcaacgagattaaagacaactcatacaccaacaatattaaagctaatgctcctgatttacttggaccaattttacgagacagcaaagatttgggtttcaacaacatggattgttccacttccatgtcagaagatctcaagaaaacttcacaattcatggatttttctgatcttgaaaccacaatgtccttggaaggatcacgagggggtagtagtcaatgtgtgagtgaggtttatagctccttcccttgcctagaggaggagtacatggtggccgttatgggcagttcagacatttcagcattgcatgattgtcacgtggctgattccaagtacgaggatgatgtgacacaagatctaatgtggaacatggatgacatttggcagtttaacgagtatgcacactttaattaggttatattatatttatgtacttcttacaacttggaggggtttatcggtcttttattaaattttgattgttttggattccttaaaaatgtgttcttattatagtttttaatgaaaaaaatgtttaagcgcaaaaaaaaaaaaaaaaaaaaaaaaaaaaaa

SEQ ID NO: 100 - protein, 283 aa, Arabidopsis thaliana
MSNITKKKCNGNEEGAEQRKGPWTLEEDTLLTNYISHNGEGRWNLLAKSSGLKRAGKSCRLRWLNYLKPDIKRGNLTPQEQLLILELHSKWGNRWSKISKYLPGRTDNDIKNYWRTRVQKQARQLNIDSNSHKFIEVVRSFWFPRLINEIKDNSYTNNIKANAPDLLGPILRDSKDLGFNNMDCSTSMSEDLKKTSQFMDFSDLETTMSLEGSRGGSSQCVSEVYSSFPCLEEEYMVAVMGSSDISALHDCHVADSKYEDDVTQDLMWNMDDIWQFNEYAHFN

SEQ ID NO: 101 - DNA, 1038 bp, Arabidopsis thaliana
atgaaatctctgtagtttttttttgttcctttcttaaatttcgaaagaaagacatttattaaaccaaaataactctttagatcattgcaaggaaaaatgttgaaaagtgcaagtccaatggcattctacgatatcggagagcagcaatactctactttcgggtacattttaagcaaacctgggaacgcaggagcttacgagattgacccttcgatcccaaacatcgacgatgcgatctacggctcagatgagttccgtatgtacgcttacaaaatcaaacggtgtcctcgtactcgtagccacgactggacggagtgtccctacgctcaccgtggcgagaaagccacacgccgtgatcctcgccgttacacttactgtgcagtcgcatgcccggctttccgaaatggcgcatgccaccgtggcgactcatgcgaattcgcacatggcgtattcgagtactggctccacccggcgcgttaccgaacacgcgcatgtaacgccgggaacttgtgtcagaggaaagtgtgtttctttgcccacgcgccggagcagctaaggcagtctgaaggaaagcacaggtgcaggtacgcatataggccggtgagggctagaggtggtggaaacggcgatggagtgacgatgagaatggacgacgagggttacgacacgtcacggtctccggtgagaagcgggaaagatgatttagatagtaacgaggagaaggtgttgttgaagtgttggagtcggatgagcattgtggatgatcattatgagccgtccgatttggatttggatttgtcacactttgattggatctcagagttggtcgattaaatttgggaaatcaaagcagagaacaaaagaaacccgataaataaagtggattttgttaaaatccacaagatcaagattcaagatgagagatcttgtcatgtatatggtaaatttaattgtaatgatttattgcaatgtcgcaaaagaagttacttctctttgcatgtaaacagattcttgatcttctataagtctttgtattaa

SEQ ID NO: 102 - protein, 245 aa, Arabidopsis thaliana
MLKSASPMAFYDIGEQQYSTFGYILSKPGNAGAYEIDPSIPNIDDAIYGSDEFRMYAYKIKRCPRTRSHDWTECPYAHRGEKATRRDPRRYTYCAVACPAFRNGACHRGDSCEFAHGVFEYWLHPARYRTRACNAGNLCQRKVCFFAHAPEQLRQSEGKHRCRYAYRPVRARGGGNGDGVTMRMDDEGYDTSRSPVRSGKDDLDSNEEKVLLKCWSRMSIVDDHYEPSDLDLDLSHFDWISELVD

SEQ ID NO: 103 - DNA, 754 bp, Arabidopsis thaliana
  misc_feature (677)..(677)
  misc_feature (677)..(677): n=a,t,c or g
gtttccacagtccctgtacttgtgcataaaactgtaaaacactactctgaaaattttgcttctgttaggatataatgccaccctctcctcctaaatctccttttattagctcttcactcaaaggagctcatgaagatcgcaaatttaaatgctataggggtgtccgaaagaggtcttggggcaaatgggtgtctgaaatcagagttccaaagactggacgacgaatatggctaggttcatacgatgctccagagaaggcagctagagcctatgatgctgctttgttctgtattaggggtgagaagggagtttacaattttcccactgataaaaagccgcagcttccagaaggttctgtccggcctctgtccaagctcgacatacagacaatagcaacaaactatgcttcatcagttgtgcatgtaccttcccatgccaccacactcccggcaacaacccaggttccctctgaagttcctgcttcctctgatgtttctgcttctactgagattacagagatggtcgatgaatattatctcccaaccgatgcaactgcagaatcaatattctcagttgaagacttacaactggacagtttcctcatgatggacattgattggataaacaatctaatctgatgtgtaacgtcacttgcagtgacatttaatatggtttanctatcagttacctgtctgcttcttgtaagggtatacttggatccttgtctttgaacttgttttatttagcatgcaaa

SEQ ID NO: 104 - protein, 187 aa, Arabidopsis thaliana
MPPSPPKSPFISSSLKGAHEDRKFKCYRGVRKRSWGKWVSEIRVPKTGRRIWLGSYDAPEKAARAYDAALFCIRGEKGVYNFPTDKKPQLPEGSVRPLSKLDIQTIATNYASSVVHVPSHATTLPATTQVPSEVPASSDVSASTEITEMVDEYYLPTDATAESIFSVEDLQLDSFLMMDIDWINNLI

SEQ ID NO: 105 - DNA, 1177 bp, Arabidopsis thaliana
tataaatcttcgtttctacttttttttcttccataatatagtcaattcgttttcttaattagggcttcttctctttgtttctccaatctttattagtttatttatttattttggttattgtatacaaatggcaatggctttaaacatgaatgcttacgtagacgagttcatggaagctcttgaaccattcatgaaggtaacttcatcttcttctacttcgaattcatcaaatccaaaaccattaactcctaatttcatccctaataatgaccaagtcttaccggtatctaaccaaaccggtccgattgggctaaaccagctcactccaacacaaatcctccaaattcagacagagttacatctccggcaaaaccaatctcgtcgtcgcgctggtagtcatcttctcaccgctaaaccaacctcaatgaagaaaatcgacgtagcaactaaaccggttaaactataccgaggcgtaagacagaggcaatggggtaaatgggtagctgagattcggctacctaaaaaccgaacccggttatggctcggtacgttcgaaacggctcaagaagctgcattagcttacgatcaagcagctcataagatcagaggagacaacgctcgtctcaatttcccagacattgttcgtcaaggacactataaacagatattgtctccgtctatcaacgcaaagatcgaatccatctgcaatagttctgatcttccactgcctcagatcgagaaacagaacaaaacagaggaggtgctctctggtttttccaaaccggagaaagaaccggaatttggggagatatacggatgcggatactcgggctcatctcctgagtcggatataacgttgttggatttctcaagcgactgtgtgaaagaagatgagagtttcttgatgggtttgcacaagtatccttctttggagattgattgggacgctatagagaaactcttctgaatccattttatctttttgattcatttgtctctaaattgtagaattttattttcagagctttgtaagggaagttcttgaatgagagttgcagaggactagtggaacctaactctgttttcttttgtaagtattgtttataatgggccgttgaatgggccttattgatttaaacagcccaagtttttaaaaaaaaaaaaaaaaaaaaaaaaa

SEQ ID NO: 106 - protein, 279 aa, Arabidopsis thaliana
MAMALNMNAYVDEFMEALEPFMKVTSSSSTSNSSNPKPLTPNFIPNNDQVLPVSNQTGPIGLNQLTPTQILQIQTELHLRQNQSRRRAGSHLLTAKPTSMKKIDVATKPVKLYRGVRQRQWGKWVAEIRLPKNRTRLWLGTFETAQEAALAYDQAAHKIRGDNARLNFPDIVRQGHYKQILSPSINAKIESICNSSDLPLPQIEKQNKTEEVLSGFSKPEKEPEFGEIYGCGYSGSSPESDITLLDFSSDCVKEDESFLMGLHKYPSLEIDWDAIEKLF

SEQ ID NO: 107 - DNA, 2580 bp, Arabidopsis thaliana
atggcgagttcggaggtttcaatgaaaggtaatcgtggaggagataacttctcctcctctggttttagtgaccctaaggagactagaaatgtctccgtcgccggcgaggggcaaaaaagtaattctacccgatccgctgcggctgagcgtgctttggaccctgaggctgctctttacagagagctatggcacgcttgtgctggtccgcttgtgacggttcctagacaagacgaccgagtcttctattttcctcaaggacacatcgagcaggtggaggcttcgacgaaccaggcggcagaacaacagatgcctctctatgatcttccgtcaaagcttctctgtcgagttattaatgtagatttaaaggcagaggcagatacagatgaagtttatgcgcagattactcttcttcctgaggctaatcaagacgagaatgcaattgagaaagaagcgcctcttcctccacctccgaggttccaggtgcattcgttctgcaaaaccttgactgcatccgacacaagtacacatggtggattttctgttcttaggcgacatgcggatgaatgtctcccacctctggatatgtctcgacagcctcccactcaagagttagttgcaaaggatttgcatgcaaatgagtggcgattcagacatatattccggggtcaaccacggaggcatttgctacagagtgggtggagtgtgtttgttagctccaaaaggctagttgcaggcgatgcgtttatatttctaaggggcgagaatggagaattaagagttggtgtaaggcgtgcgatgcgacaacaaggaaacgtgccgtcttctgttatatctagccatagcatgcatcttggagtactggccaccgcatggcatgccatttcaacagggactatgtttacagtctactacaaacccaggacgagcccatctgagtttattgttccgttcgatcagtatatggagtctgttaagaataactactctattggcatgagattcaaaatgagatttgaaggcgaagaggctcctgagcagaggtttactggcacaatcgttgggattgaagagtctgatcctactaggtggccaaaatcaaagtggagatccctcaaggtgagatgggatgagacttctagtattcctcgacctgatagagtatctccgtggaaagtagagccagctcttgctcctcctgctttgagtcctgttccaatgcctaggcctaagaggcccagatcaaatatagcaccttcatctcctgactcttcgatgcttaccagagaaggtacaactaaggcaaacatggaccctttaccagcaagcggactttcaagggtcttgcaaggtcaagaatactcgaccttgaggacgaaacatactgagagtgtagagtgtgatgctcctgagaattctgttgtctggcaatcttcagcggatgatgataaggttgacgtggtttcgggttctagaagatatggatctgagaactggatgtcctcagccaggcatgaacctacttacacagatttgctctccggctttgggactaacatagatccatcccatggtcagcggatacctttttatgaccattcatcatcaccttctatgcctgcaaagagaatcttgagtgattcagaaggcaagttcgattatcttgctaaccagtggcagatgatacactctggtctctccctgaagttacatgaatctcctaaggtacctgcagcaactgatgcgtctctccaagggcgatgcaatgttaaatacagcgaatatcctgttcttaatggtctatcgactgagaatgctggtggtaactggccaatacgtccacgtgctttgaattattatgaggaagtggtcaatgctcaagcgcaagctcaggctagggagcaagtaacaaaacaacccttcacgatacaagaggagacagcaaagtcaagagaagggaactgcaggctctttggcattcctctgaccaacaacatgaatgggacagactcaaccatgtctcagagaaacaacttgaatgatgctgcggggcttacacagatagcatcaccaaaggttcaggacctttcagatcagtcaaaagggtcaaaatcaacaaacgatcatcgtgaacagggaagaccattccagactaataatcctcatccgaaggatgctcaaacgaaaaccaactcaagtaggagttgcacaaaggttcacaagcagggaattgcacttggccgttcagtggatctttcaaagttccaaaactatgaggagttagtcgctgagctggacaggctgtttgagttcaatggagagttgatggctcctaagaaagattggttgatagtttacacagatgaagagaatgatatgatgcttgttggtgacgatccttggcaggagttttgttgcatggttcgcaaaatcttcatatacacgaaagaggaagtgaggaagatgaacccggggactttaagctgtaggagcgaggaagaagcagttgttggggaaggatcagatgcaaaggacgccaagtctgcatcaaatccttcattgtccagcgctgggaactcttaa

SEQ ID NO: 108 - protein, 859 aa, Arabidopsis thaliana
MASSEVSMKGNRGGDNFSSSGFSDPKETRNVSVAGEGQKSNSTRSAAAERALDPEAALYRELWHACAGPLVTVPRQDDRVFYFPQGHIEQVEASTNQAAEQQMPLYDLPSKLLCRVINVDLKAEADTDEVYAQITLLPEANQDENAIEKEAPLPPPPRFQVHSFCKTLTASDTSTHGGFSVLRRHADECLPPLDMSRQPPTQELVAKDLHANEWRFRHIFRGQPRRHLLQSGWSVFVSSKRLVAGDAFIFLRGENGELRVGVRRAMRQQGNVPSSVISSHSMHLGVLATAWHAISTGTMFTVYYKPRTSPSEFIVPFDQYMESVKNNYSIGMRFKMRFEGEEAPEQRFTGTIVGIEESDPTRWPKSKWRSLKVRWDETSSIPRPDRVSPWKVEPALAPPALSPVPMPRPKRPRSNIAPSSPDSSMLTREGTTKANMDPLPASGLSRVLQGQEYSTLRTKHTESVECDAPENSVVWQSSADDDKVDVVSGSRRYGSENWMSSARHEPTYTDLLSGFGTNIDPSHGQRIPFYDHSSSPSMPAKRILSDSEGKFDYLANQWQMIHSGLSLKLHESPKVPAATDASLQGRCNVKYSEYPVLNGLSTENAGGNWPIRPRALNYYEEVVNAQAQAQAREQVTKQPFTIQEETAKSREGNCRLFGIPLTNNMNGTDSTMSQRNNLNDAAGLTQIASPKVQDLSDQSKGSKSTNDHREQGRPFQTNNPHPKDAQTKTNSSRSCTKVHKQGIALGRSVDLSKFQNYEELVAELDRLFEFNGELMAPKKDWLIVYTDEENDMMLVGDDPWQEFCCMVRKIFIYTKEEVRKMNPGTLSCRSEEEAVVGEGSDAKDAKSASNPSLSSAGNS

SEQ ID NO: 109 - DNA, 606 bp, Arabidopsis thaliana
atgagcggaggaggagacgtgaacatgagtggtggagacagacgcaagggaacggtgaagtggtttgatacacagaaggggtttggtttcatcacacctagcgacggtggtgacgatctcttcgttcaccagtcttccatcagatctgaaggatttcgtagcctcgcagctgaggaatctgttgagttcgacgttgaggttgacaactccggccgtcccaaggctattgaagtgtctggacccgacggtgctcccgttcagggtaacagcggtggtggtggttcatctggtggacgcggtggttttggcggcggtggtggaagaggagggggacgtggtggaggaagctacggaggaggttatggtggaagaggaagcggtggccgtggaggaggtggtggtgataattcttgctttaagtgcggtgaaccaggtcacatggcgagagaatgctctcaaggtggtggaggatacagcggaggcgggggtggtggaaggtacgggtctggcggcggcggaggaggaggtggtggtggcttaagctgctacagctgtggagagtctgggcactttgcaagggattgcactagcggtggtgctcgttga

SEQ ID NO: 110 - protein, 201 aa, Arabidopsis thaliana
MSGGGDVNMSGGDRRKGTVKWFDTQKGFGFITPSDGGDDLFVHQSSIRSEGFRSLAAEESVEFDVEVDNSGRPKAIEVSGPDGAPVQGNSGGGGSSGGRGGFGGGGGRGGGRGGGSYGGGYGGRGSGGRGGGGGDNSCFKCGEPGHMARECSQGGGGYSGGGGGGRYGSGGGGGGGGGGLSCYSCGESGHFARDCTSGGAR

SEQ ID NO: 111 - DNA, 1384 bp, Arabidopsis thaliana
ttcacttgagaacaaccccctttgaactcgatcaagaaagctaagtttgaagaatcaagaatggtgcggacaccgtgttgcaaagccgaactagggttaaagaaaggagcttggactcccgaggaagatcagaagcttctctcttaccttaaccgccacggtgaaggtggatggcgaactctccccgaaaaagctggactcaagagatgcggcaaaagctgcagactgagatgggccaattatcttagacctgacatcaaaagaggagagttcactgaagacgaagaacgttcaatcatctctcttcacgcccttcacggcaacaaatggtctgctatagctcgtggactaccaggaagaaccgataacgagatcaagaactactggaacactcatatcaaaaaacgtttgatcaagaaaggtattgatccagttacacacaagggcataacctccggtaccgacaaatcagaaaacctcccggagaaacaaaatgttaatctgacaactagtgaccatgatcttgataatgacaaggcgaagaagaacaacaagaattttggattatcatcggctagtttcttgaacaaagtagctaataggttcggaaagagaatcaatcagagtgttctgtctgagattatcggaagtggaggcccacttgcttctactagtcacactactaatactacaactacaagtgtttccgttgactctgaatcagttaagtcaacgagttcttccttcgcaccaacctcgaatcttctctgccatgggaccgttgcaacaacaccagtttcatcgaactttgacgttgatggtaacgttaatctgacgtgttcttcgtccacgttctctgattcctccgttaacaatcctctaatgtactgcgataatttcgttggtaataacaacgttgatgatgaggatactatcgggttctccacatttctgaatgatgaagatttcatgatgttggaggagtcttgtgttgaaaacactgcgttcatgaaagaacttacgaggtttcttcacgaggatgaaaacgacgtcgttgatgtgacgccggtctatgaacgtcaagacttgtttgacgaaattgataactattttggatgagtgaaactcataatcgatgaatcccacgtgaccatgtcaatatgatgtctatggatatgttaccttgatgatgttgatggtaataataataaataatagatggtgatgatgaccatgcatgaatcatgaatgtagttcgtgttgtcacatatgcttgtgtttttgtgttttttttttttggtctgaagtgtgttgtttcgttgtaaatggattataaatggtgatgtaataattataatgttaaaaaaaaaaaaaaaaaaaaaaa

SEQ ID NO: 112 - protein, 352 aa, Arabidopsis thaliana
MVRTPCCKAELGLKKGAWTPEEDQKLLSYLNRHGEGGWRTLPEKAGLKRCGKSCRLRWANYLRPDIKRGEFTEDEERSIISLHALHGNKWSAIARGLPGRTDNEIKNYWNTHIKKRLIKKGIDPVTHKGITSGTDKSENLPEKQNVNLTTSDHDLDNDKAKKNNKNFGLSSASFLNKVANRFGKRINQSVLSEIIGSGGPLASTSHTTNTTTTSVSVDSESVKSTSSSFAPTSNLLCHGTVATTPVSSNFDVDGNVNLTCSSSTFSDSSVNNPLMYCDNFVGNNNVDDEDTIGFSTFLNDEDFMMLEESCVENTAFMKELTRFLHEDENDVVDVTPVYERQDLFDEIDNYFG

SEQ ID NO: 113 - DNA, 766 bp, Arabidopsis thaliana
gacatgcatgtaagcattcggttaattaatcgagtcaaagatatatatcagtaaatacatatgtgtatatttctggaaaaagaatatatatattgagaaataagaaaagatgaaaatggaaaatggtatgtataaaaagaaaggagtgtgcgactcttgtgtctcgtccaaaagcagatccaaccacagccccaaaagaagcatgatggagcctcagcctcaccatctcctcatggattggaacaaagctaatgatcttctcacacaagaacacgcagcttttctcaatgatcctcaccatctcatgttagatccacctcccgaaaccctaattcacttggacgaagacgaagagtacgatgaagacatggatgcgatgaaggagatgcagtacatgatcgccgtcatgcagcccgtagacatcgaccctgccacggtccctaagccgaaccgccgtaacgtaaggataagcgacgatcctcagacggtggttgctcgtcggcgtcgggaaaggatcagcgagaagatccgaattctcaagaggatcgtgcctggtggtgcgaagatggacacagcttccatgctcgacgaagccatacgttacaccaagttcttgaaacggcaggtgaggattcttcagcctcactctcagattggagctcctatggctaacccctcttacctttgttattaccacaactcccaaccctgatgaactacacagaagctcgctagctagacatttggtgtcatcctctcaaccttt

SEQ ID NO: 114 - protein, 200 aa, Arabidopsis thaliana
MKMENGMYKKKGVCDSCVSSKSRSNHSPKRSMMEPQPHHLLMDWNKANDLLTQEHAAFLNDPHHLMLDPPPETLIHLDEDEEYDEDMDAMKEMQYMIAVMQPVDIDPATVPKPNRRNVRISDDPQTVVARRRRERISEKIRILKRIVPGGAKMDTASMLDEAIRYTKFLKRQVRILQPHSQIGAPMANPSYLCYYHNSQP

SEQ ID NO: 115 - DNA, 1444 bp, Arabidopsis thaliana
cgtcgactctctactcaacaccactcaatttcatctctctttttcccttccattgttagtataaaaaccaagcaaacccttaatcacttttcatcatcatatatcaccttaatccacatgcatacacatatctagtctttttgatatatggcaattgtatcctccacaacaagcatcattcccatgagtaaccaagtcaacaataacgaaaaaggtatagaagacaatgatcatagaggcggccaagagagtcatgtccaaaatgaagatgaagctgatgatcatgatcatgacatggtcatgcccggatttagattccatcctaccgaagaagaactcatagagttttaccttcgccgaaaagttgaaggcaaacgctttaatgtagaactcatcactttcctcgatctttatcgctatgatccttgggaacttcctgctatggcggcgataggagagaaagagtggtacttctatgtgccaagagatcggaaatatagaaatggagatagaccgaaccgagtaacgacttcaggatattggaaagccaccggagctgataggatgatcagatcggagacttctcggcctatcggattaaagaaaaccctagttttctactctggtaaagcccctaaaggcactcgtactagttggatcatgaacgagtatcgtcttccgcaccatgaaaccgagaagtaccaaaaggctgaaatatcattgtgccgagtgtacaaaaggccaggagtagaagatcatccatcggtaccacgttctctctccacaagacatcataaccataactcatcgacatcatcccgtttagccttaagacaacaacaacaccattcatcctcctctaatcattccgacaacaaccttaacaacaacaacaacatcaacaatctcgagaagctctccaccgaatattccggcgacggcagcacaacaacaacgaccacaaacagtaactctgacgttaccattgctctagccaatcaaaacatatatcgtccaatgccttacgacacaagcaacaacacattgatagtctctacgagaaatcatcaagacgatgatgaaactgccattgttgacgatcttcaaagactagttaactaccaaatatcagatggaggtaacatcaatcaccaatactttcaaattgctcaacagtttcatcatactcaacaacaaaatgctaacgcaaacgcattacaattggtggctgcggcgactacagcgacaacgctaatgcctcaaactcaagcggcgttagctatgaacatgattcctgcaggaacgattccaaacaatgctttgtgggatatgtggaatccaatagtaccagatggaaacagagatcactatactaatattccttttaagtaatttaattagatcatgattattatccatgacaataattaatgctgctttgcgc

SEQ ID NO: 116 - protein, 414 aa, Arabidopsis thaliana
MAIVSSTTSIIPMSNQVNNNEKGIEDNDHRGGQESHVQNEDEADDHDHDMVMPGFRFHPTEEELIEFYLRRKVEGKRFNVELITFLDLYRYDPWELPAMAAIGEKEWYFYVPRDRKYRNGDRPNRVTTSGYWKATGADRMIRSETSRPIGLKKTLVFYSGKAPKGTRTSWIMNEYRLPHHETEKYQKAEISLCRVYKRPGVEDHPSVPRSLSTRHHNHNSSTSSRLALRQQQHHSSSSNHSDNNLNNNNNINNLEKLSTEYSGDGSTTTTTTNSNSDVTIALANQNIYRPMPYDTSNNTLIVSTRNHQDDDETAIVDDLQRLVNYQISDGGNINHQYFQIAQQFHHTQQQNANANALQLVAAATTATTLMPQTQAALAMNMIPAGTIPNNALWDMWNPIVPDGNRDHYTNIPFK

SEQ ID NO: 117 - DNA, 833 bp, Arabidopsis thaliana
  misc_feature (810)..(810): n=a,t,c or g
caccaaactcacctgaaaccctatttccatttaccattcacactaatggcacgaccacaacaacgctttcgaggcgttagacagaggcattggggctcttgggtctccgaaattcgtcaccctctcttgaaaacaagaatctggctagggacgtttgagacagcggaggatgcagcaagggcctacgacgaggcggctaggctaatgtgtggcccgagagctcgtactaatttcccatacaaccctaatgccattcctacttcctcttccaagcttctatcagcaactcttaccgctaaactccacaaatgctacatggcttctcttcaaatgaccaagcaaacgcaaacacaaacgcaaacgcagaccgcaagatcacaatccgcggacagtgacggtgtgacggctaacgaaagtcatttgaacagaggagtaacggagacgacagagatcaagtgggaagatggaaatgcgaatatgcaacagaattttaggccattggaggaagatcatatcgagcaaatgattgaggagctgcttcactacggttccattgagctttgctctgttttaccaactcagacgctgtgagaaatggccttgtcgttttagcgtattcttttcatttttatttttgtttccacaaaaacggcgtcgtaagtgatgagagtagtagtgagagaaggctaatttcaagacattttgatctgaattggcctcttttgaaacactgattctagtttctataagagcaatcgatcatatgctatgttatgtatagtattataaaaaaatgttattttctgattnaaaaaaaaaaaaaaaaaaaaaaa

SEQ ID NO: 118 - protein, 181 aa, Arabidopsis thaliana
MARPQQRFRGVRQRHWGSWVSEIRHPLLKTRIWLGTFETAEDAARAYDEAARLMCGPRARTNFPYNPNAIPTSSSKLLSATLTAKLHKCYMASLQMTKQTQTQTQTQTARSQSADSDGVTANESHLNRGVTETTEIKWEDGNANMQQNFRPLEEDHIEQMIEELLHYGSIELCSVLPTQTL

SEQ ID NO: 119 - DNA, 1148 bp, Arabidopsis thaliana
gttaaagaagatggatgggccacaagttgctatataaatccttccacttcttgttgtatactattgcttgagttctgattgggcacagtagtaccattgccatttctctcacacataccgtctctttctctcatcatcaatcatcaatcatccaaaagaaaaaaccctaaaatttcacttgtaagcttttcaccagtttctctccatacccattttatcagcttctccatatctttctctatggattctgacataatgaacatgatgatgcatcagatggagaagcttcctgagttttgtaaccctaattcctctttcttctctcccgaccacaacaacacttacccttttctctttaactccactcattaccagtccgatcactcaatgaccaacgaaccaggtttccgctacggttccggtttactcactaacccttcttctatctctcccaacacagcttactcttccgtttttcttgacaaaagaaacaacagtaacaacaacaataatggcacgaacatggcagctatgcgagagatgatcttccgtatcgccgtgatgcaaccgatccatatcgatcccgaggcggttaagccaccgaagaggaggaacgtcaggatctctaaagatcctcaaagcgtggcggctaggcatagaagggagagaataagcgagaggattcggattttgcaacggcttgttcctggtgggacgaagatggatacagcttcgatgctcgatgaagcaattcattatgtgaagtttttaaagaaacaggtgcagtctctggaggagcaggcggtggttactggcggagggggaggaggaggaggaagggttttgatcggtggaggtggaatgacggcggcgagtggtggtggtggcggcgggggagtggttatgaaagggtgtggaacagtggggactcatcagatggtgggcaatgcacagattcttagatgatgatgatttttaattttattattattatattaatgttggagaaaaagagaaaaatgattctggagagggaagccaagtaatttatgtgagagtctttaatttaactttattttcttgtttagataatgtgtaatgatggtttttaaagccaaagactctccatggttgttggagcgagtttg

SEQ ID NO: 120 - protein, 241 aa, Arabidopsis thaliana
MDSDIMNMMMHQMEKLPEFCNPNSSFFSPDHNNTYPFLFNSTHYQSDHSMTNEPGFRYGSGLLTNPSSISPNTAYSSVFLDKRNNSNNNNNGTNMAAMREMIFRIAVMQPIHIDPEAVKPPKRRNVRISKDPQSVAARHRRERISERIRILQRLVPGGTKMDTASMLDEAIHYVKFLKKQVQSLEEQAVVTGGGGGGGGRVLIGGGGMTAASGGGGGGGVVMKGCGTVGTHQMVGNAQILR

SEQ ID NO: 121 - DNA, 956 bp, Arabidopsis thaliana
atccaagatcctccaactcacagaaaggcagattcaagaacagtagtgaaggagagatctggtaaaatggcgagagagaagataaggataaagaagattgataacataacagcgagacaagttactttctcaaagagaagaagaggaatcttcaagaaagccgatgaactttcagttctttgcgatgctgatgttgctctcatcatcttctctgccaccggaaagctcttcgagttctccagctcaagaatgagagacatattgggaaggtatagtcttcatgcaagtaacatcaacaaattgatggatccaccttctactcatctccggcttgagaattgtaacctctccagactaagtaaggaagtcgaagacaaaaccaagcagctacggaaactgagaggagaggatcttgatggattgaacttagaagagttgcagcggctggagaaactacttgaatccggacttagccgtgtgtctgaaaagaagggcgagtgtgtgatgagccaaattttctcacttgagaaacggggatcggaattggtggatgagaataagagactgagggataaactagagacgttggaaagggcaaaactgacgacgcttaaagaggctttggagacagagtcggtgaccacaaatgtgtcaagctacgacagtggaactccccttgaggatgactccgacacttccctgaagcttgggcttccatcttgggaatgaatctgagagagagaaagatccagcagagttgacttcgatggaagcccacaaatattaagtctaccttttccctttcttttctttgaataagtgttgaaaaagaattgagatgggaaggatgaattctcattgcattgcagagaagcaagtttcagatattgtacgtgttattgggtctttataactatttttctccccaaaaaaaaaaaaaaaaaaaaaaaaaaaaa

SEQ ID NO: 122 - protein, 220 aa, Arabidopsis thaliana
MAREKIRIKKIDNITARQVTFSKRRRGIFKKADELSVLCDADVALIIFSATGKLFEFSSSRMRDILGRYSLHASNINKLMDPPSTHLRLENCNLSRLSKEVEDKTKQLRKLRGEDLDGLNLEELQRLEKLLESGLSRVSEKKGECVMSQIFSLEKRGSELVDENKRLRDKLETLERAKLTTLKEALETESVTTNVSSYDSGTPLEDDSDTSLKLGLPSWE

SEQ ID NO: 123 - DNA, 1164 bp, Arabidopsis thaliana
actctctcaaaccataaaaaatattctccgatcatcattttaatggagagtacagattcttccggtggtcctccgccgccgcaaccaaacctccctccaggattccggtttcatccaacagacgaagaacttgtaattcattacctcaaacgcaaagcagattctgttcctttaccagtcgcgatcatcgccgacgttgatctttacaaatttgatccatgggaacttcccgcgaaagcttcgtttggagaacaagaatggtattttttcagtccaagagatcggaaatatcccaacggagctagacctaaccgagctgcgacttccggttattggaaagcgactggtacagataaaccggtgatttcaaccggcggtggtggtagtaaaaaagtgggagttaaaaaggctctagtgttttacagtggtaaaccaccaaaaggagttaaatcagattggattatgcatgaatatcggttaactgataataaacctactcacatttgtgacttcggcaacaagaaaaactctctcaggcttgatgattgggtgttgtgtcgtatctacaagaaaaacaatagtacagcatctagacatcatcatcatcttcatcatattcatctagataatgatcatcatcgtcatgatatgatgattgatgatgatcgattccgtcatgttcctcctggtcttcacttcccggcgattttttctgacaataatgatccgacggctatatatgatggtggcggcggcggatacggaggtggaagttactcgatgaatcattgtttcgcatctggatcaaagcaggagcagttgtttccaccggtgatgatgatgactagtctaaatcaagattccggtattggatcgtcgtcgtcacctagcaagagatttaacggcggcggcgttggagattgttcgacttctatggcggcgacgccgttaatgcagaaccaaggtgggatttaccaattgcctggtttgaattggtattcttgaaaacaatttacgatgaagaatttttaaaatttgtgtatatatatacggtttgagtgattagggggcattgggggatttatttacggttgattattattgtagtgttatagaactaaggagattaaattaaatagattggaggaaaaaaaaaaaaaaaaa

SEQ ID NO: 124 - protein, 320 aa, Arabidopsis thaliana
MESTDSSGGPPPPQPNLPPGFRFHPTDEELVIHYLKRKADSVPLPVAIIADVDLYKFDPWELPAKASFGEQEWYFFSPRDRKYPNGARPNRAATSGYWKATGTDKPVISTGGGGSKKVGVKKALVFYSGKPPKGVKSDWIMHEYRLTDNKPTHICDFGNKKNSLRLDDWVLCRIYKKNNSTASRHHHHLHHIHLDNDHHRHDMMIDDDRFRHVPPGLHFPAIFSDNNDPTAIYDGGGGGYGGGSYSMNHCFASGSKQEQLFPPVMMMTSLNQDSGIGSSSSPSKRFNGGGVGDCSTSMAATPLMQNQGGIYQLPGLNWYS

SEQ ID NO: 125 - DNA, 799 bp, Arabidopsis thaliana
tagacagagagaaatagaaatagagagagagagacatgaagagcactctcaatagagaagagaaggaagcatgaagctagctctgcagcttcaaggtctcattaatggaggtctctaactcttgttcttcattttcttcatcctctgtcgacagtactaaaccttctccttctgaatcttctgttaatctctcccttagtctcacatttccttctacttctccacaaagagaagcaagacaagattggccaccgataaagtctagattaagagatacactaaagggtcgtcgtcttcttcgtcgtggtgatgacacttctctctttgttaaggtttatatggaaggtgttcccattggaagaaaactcgacctttgcgtattctcaggctacgagagtctattagaaaatctctctcacatgttcgatacttcaatcatctgcggtaatcgagatcgaaaacatcatgttttgacatatgaagacaaggatggagattggatgatggtcggagatattccatgggatatgtttcttgaaaccgtgagaagactaaagatcacgagaccggagaggtattaaaacttggatcggtcaaggctgtgattgcgcagttacgagacgtgtaagatttaggcattgatgaagagacttgaggcgggacggagctattgctgcatattgcaacaaaggccttgaagaagttggagaattgattgatgcatatatttatttatatgacacctttgagtgtgttttttcttataaataaatcacaatatccaagacttctctttaaa

SEQ ID NO: 126 - protein, 158 aa, Arabidopsis thaliana
MEVSNSCSSFSSSSVDSTKPSPSESSVNLSLSLTFPSTSPQREARQDWPPIKSRLRDTLKGRRLLRRGDDTSLFVKVYMEGVPIGRKLDLCVFSGYESLLENLSHMFDTSIICGNRDRKHHVLTYEDKDGDWMMVGDIPWDMFLETVRRLKITRPERY

SEQ ID NO: 127 - DNA, 678 bp, Arabidopsis thaliana
atgccttctgaattcagtgaatctcgtcgggttcctaagattccccacggccaaggaggatctgttgcgattccgacggatcaacaagagcagctttcttgtcctcgctgtgaatcaaccaacaccaagttctgttactacaacaactacaacttctcacaacctcgtcatttctgcaagtcttgtcgccgttactggactcatggaggtactctccgtgacattcccgtcggtggtgtttcccgtaaaagctcaaaacgttcccggacttattcctctgccgctaccacctccgttgtcggaagccggaactttcccttacaagctacgcctgttcttttccctcagtcgtcttccaacggcggtatcacgacggcgaagggaagtgcttcgtcgttctatggcggtttcagctctttgatcaactacaacgccgccgtgagcagaaatgggcctggtggcgggtttaatgggccagatgcttttggtcttgggcttggtcacgggtcgtattatgaggacgtcagatatgggcaaggaataacggtctggccgttttcaagtggcgctactgatgctgcaactactacaagccacattgctcaaatacccgccacgtggcagtttgaaggtcaagagagcaaagtcgggttcgtgtctggagactacgtagcgtga

SEQ ID NO: 128 - protein, 225 aa, Arabidopsis thaliana
MPSEFSESRRVPKIPHGQGGSVAIPTDQQEQLSCPRCESTNTKFCYYNNYNFSQPRHFCKSCRRYWTHGGTLRDIPVGGVSRKSSKRSRTYSSAATTSVVGSRNFPLQATPVLFPQSSSNGGITTAKGSASSFYGGFSSLINYNAAVSRNGPGGGFNGPDAFGLGLGHGSYYEDVRYGQGITVWPFSSGATDAATTTSHIAQIPATWQFEGQESKVGFVSGDYVA

SEQ ID NO: 129 - DNA, 1024 bp, Arabidopsis thaliana
tcttcttcttcctccataccttatctcaccagcttctccatatctctcaaagaaaaaacaaaccctataaattccacaaaaaaggaggatggataactccgacattctaatgaacatgatgatgcagcagatggagaagcttcctgaacacttctctaactcaaaccctaaccctaatccccataacattatgatgctttctgaatccaacacccacccgttcttcttcaaccccactcattctcatctcccatttgaccaaaccatgcctcaccaccaacccggtttaaatttccggtacgccccctccccgtcatcatctctcccggagaagagaggaggctgcagcgacaacgccaacatggcggcgatgagagagatgatctttcgaatagccgtgatgcagcctatacatattgatccggaatccgtaaagccaccaaagagaaagaacgtgaggatctctaaggatccacagagcgtggcagctcggcatcgaagggagaggataagcgagcggattcggattcttcagcggcttgttcccggtgggactaagatggatacggcgtcgatgctcgatgaggctatccattacgttaagtttctcaagaagcaagtgcagtcgctggaggaacatgcggtggttaacggcggaggaatgacggcggtggccggaggagcacttgcgggtactgttggtggaggatatggaggaaaagggtgtggcattatgcggtctgatcatcaccagatgcttggaaatgcacagattcttagatgatgatgatgttgatttttaaatatatatcatatgtttattaatatgacgggaaaaaatattatcgagggagttgaatttagtatcatgaaactatgagagcattttttttaaatgtttttatctttccgggtttcgataatgtttgggatggttaattaacaatttaaaagtcagacaacttggttgtaaagactaaagaataagcatagtttatcaatttatcattactaaatgaaatag

SEQ ID NO: 130 - protein, 231 aa, Arabidopsis thaliana
MDNSDILMNMMMQQMEKLPEHFSNSNPNPNPHNIMMLSESNTHPFFFNPTHSHLPFDQTMPHHQPGLNFRYAPSPSSSLPEKRGGCSDNANMAAMREMIFRIAVMQPIHIDPESVKPPKRKNVRISKDPQSVAARHRRERISERIRILQRLVPGGTKMDTASMLDEAIHYVKFLKKQVQSLEEHAVVNGGGMTAVAGGALAGTVGGGYGGKGCGIMRSDHHQMLGNAQILR

SEQ ID NO: 131 - DNA, 1005 bp, Arabidopsis thaliana
atgaacatatcagtaaacggacagtcacaagtacctcctggctttaggtttcacccaaccgaggaagagctcttgaagtattacctccgcaagaaaatctctaacatcaagatcgatctcgatgttattcctgacattgatctcaacaagctcgagccttgggatattcaagagatgtgtaagattggaacgacgccgcaaaacgattggtacttttatagccataaggacaagaagtatcccaccgggactagaaccaacagagccaccacggtcggattttggaaagcgacgggacgtgacaagaccatatataccaatggtgatagaatcgggatgcgaaagacgcttgtcttctacaaaggtcgagcccctcatggtcagaaatccgattggatcatgcacgaatatagactcgacgagagtgtattaatctcctcgtgtggcgatcatgacgtcaacgtagaaacgtgtgatgtcataggaagtgacgaaggatgggtggtgtgtcgtgttttcaagaaaaataacctttgcaaaaacatgattagtagtagcccggcgagttcggtgaaaacgccgtcgttcaatgaggagactatcgagcaacttctcgaagttatggggcaatcttgtaaaggagagatagttttagaccctttcttaaaactccctaacctcgaatgccataacaacaccaccatcacgagttatcagtggttaatcgacgaccaagtcaacaactgccacgtcagcaaagttatggatcccagcttcatcactagctgggccgctttggatcggctcgttgcctcacagttaaatgggcccaactcgtattcaataccagccgttaatgagacttcacaatcaccgtatcatggactgaaccggtccggttgtaataccggtttaacaccagattactatataccggagattgatttatggaacgaggcagatttcgcgagaacgacatgccacttgttgaacggtagtggataa

SEQ ID NO: 132 - protein, 334 aa, Arabidopsis thaliana
MNISVNGQSQVPPGFRFHPTEEELLKYYLRKKISNIKIDLDVIPDIDLNKLEPWDIQEMCKIGTTPQNDWYFYSHKDKKYPTGTRTNRATTVGFWKATGRDKTIYTNGDRIGMRKTLVFYKGRAPHGQKSDWIMHEYRLDESVLISSCGDHDVNVETCDVIGSDEGWVVCRVFKKNNLCKNMISSSPASSVKTPSFNEETIEQLLEVMGQSCKGEIVLDPFLKLPNLECHNNTTITSYQWLIDDQVNNCHVSKVMDPSFITSWAALDRLVASQLNGPNSYSIPAVNETSQSPYHGLNRSGCNTGLTPDYYIPEIDLWNEADFARTTCHLLNGSG

SEQ ID NO: 133 - DNA, 1502 bp, Arabidopsis thaliana
tcgacttcctgtgaactcatctgtttgttctcttcttccggtttcactttttcatgtcctgccgttattacaacgaggattgtgtttgatccgatggaaggattggaatctgtgtacgctcaagctatgtatggaatgacacgagagagcaaaatcatggagcatcaaggatcagatttgatttggggaggaaatgagctaatggctcgagaactctgttcttcttcttcttatcaccaccaactcattaatccgaatcttagcagctgtttcatgtctgatcttggagtcttaggtgagattcaacagcagcaacatgttggcaacagagctagctcgatagatccatcatcactcgattgtttgttatctgcgacgtcgaatagcaacaacacctcgacggaggacgatgaaggaatatctgtgcttttctcagattgtcagactctttggagctttggtggagtctcatctgcagagtctgagaacagagagatcactactgagacgacaacaacgataaagcctaagcctttgaagagaaacagaggaggagatggaggaactactgagactacaacaacaacaacaaaacctaagtctttgaagagaaacagaggagacgagacaggaagtcactttagtcttgttcatcctcaagatgattcggagaaaggaggtttcaagcttatatacgatgagaatcaatcgaaatcaaagaaaccaagaacagagaaagaacgaggcggttcttcgaacattagtttccaacattcaacttgtttgtctgacaatgtcgagcccgatgctgaggcgattgcacaaatgaaggagatgatatacagagcggctgcatttagaccggtgaatttcgggttagagattgtggagaagcctaagaggaagaacgtcaagatatcgacggatcctcaaacggttgcagcgagacagagaagggagaggataagtgagaagattagggttttacaaacattggttccaggtgggacgaagatggatactgcatcaatgcttgatgaagctgctaattatctcaagttccttagagcacaagtaaaagctttagaaaacttgagacccaagcttgaccaaaccaatctctctttctcttctgctcctacatcgtttccattattccacccatcttttcttccattgcaaaatcctaatcaaatccatcatccagagtgttgacagattataaacttttgagtttcatcatcatcaacagaatcatggcgtcttgattgttttagcagttctcaagaaaggcaacttctgtgacaagggtggtgtcgggcagtgttgtttacactttccagtctttgttttgcatttctttttatataaagtttgtattttatatagaatctgtggaattcgagggttgaaatattgtgaaaaacagagccgcaagaggttaattacagtctctgcaatattttcaaccttttattactttattagagtaaagatagcgt

SEQ ID NO: 134 - protein, 373 aa, Arabidopsis thaliana
MEGLESVYAQAMYGMTRESKIMEHQGSDLIWGGNELMARELCSSSSYHHQLINPNLSSCFMSDLGVLGEIQQQQHVGNRASSIDPSSLDCLLSATSNSNNTSTEDDEGISVLFSDCQTLWSFGGVSSAESENREITTETTTTIKPKPLKRNRGGDGGTTETTTTTTKPKSLKRNRGDETGSHFSLVHPQDDSEKGGFKLIYDENQSKSKKPRTEKERGGSSNISFQHSTCLSDNVEPDAEAIAQMKEMIYRAAAFRPVNFGLEIVEKPKRKNVKISTDPQTVAARQRRERISEKIRVLQTLVPGGTKMDTASMLDEAANYLKFLRAQVKALENLRPKLDQTNLSFSSAPTSFPLFHPSFLPLQNPNQIHHPEC

SEQ ID NO: 135 - DNA, 896 bp, Arabidopsis thaliana
gagatcttctactacttgttttcttcaagaataataattttcgttttatatatggaagatgctggtgaacatttacggtgtaacgataacgttaacgacgaggagcgtttgccattggagtttatgatcggaaactcaacatccacggcggagctacagccgcctccaccgttcttggtaaagacatacaaagtggtggaggatccgacgacggacggggttatatcttggaacgaatacggaactggtttcgtcgtgtggcagccggcagaattcgctagagatctgttaccaacacttttcaagcattgcaacttctctagcttcgttcgccagctcaatacttacggttttcgaaaagtaacgacgataagatgggaatttagtaatgagatgtttcgaaaggggcaaagagagcttatgagcaatatccgaagaaggaagagccaacattggtcacacaacaagtctaatcaccaggttgtaccaacaacaacgatggtgaatcaagaaggtcatcaacggattgggattgatcatcaccatgaggatcaacagtcttccgccacttcatcctctttcgtatacactgcattactcgacgaaaacaaatgcttgaagaatgaaaacgagttattaagctgcgaacttgggaaaaccaagaagaaatgcaagcagcttatggagttggtggagagatacagaggagaagacgaagatgcaactgatgaaagtgatgatgaagaagatgaagggcttaagttgttcggagtaaaacttgaatgaaactagattgctagattgatattcgtaatataccagtttcttcatattcttagaagttttgcataactatatatagtactcttttaagacatgcaagatcagaacatatg

SEQ ID NO: 136 - protein, 244 aa, Arabidopsis thaliana
MEDAGEHLRCNDNVNDEERLPLEFMIGNSTSTAELQPPPPFLVKTYKVVEDPTTDGVISWNEYGTGFVVWQPAEFARDLLPTLFKHCNFSSFVRQLNTYGFRKVTTIRWEFSNEMFRKGQRELMSNIRRRKSQHWSHNKSNHQVVPTTTMVNQEGHQRIGIDHHHEDQQSSATSSSFVYTALLDENKCLKNENELLSCELGKTKKKCKQLMELVERYRGEDEDATDESDDEEDEGLKLFGVKLE

SEQ ID NO: 137 - DNA, 727 bp, Arabidopsis thaliana
accaaactcaaaaaacacaaaccacaagaggatcatttcattttttattgtttcgttttaatcatcatcatcagaagaaaaatggttgcgatatcggagatcaagtcgacggtggatgtcacggcggcgaattgtttgatgcttttatctagagttggacaagaaaacgttgacggtggcgatcaaaaacgcgttttcacatgtaaaacgtgtttgaagcagtttcattcgttccaagccttaggaggtcaccgtgcgagtcacaagaagcctaacaacgacgctttgtcgtctggattgatgaagaaggtgaaaacgtcgtcgcatccttgtcccatatgtggagtggagtttccgatgggacaagctttgggaggacacatgaggagacacaggaacgagagtggggctgctggtggcgcgttggttacacgcgctttgttgccggagcccacggtgactacgttgaagaaatctagcagtgggaagagagtggcttgtttggatctgagtctagggatggtggacaatttgaatctcaagttggagcttggaagaacagtttattgattttatttattttccttaaattttctgaatatatttgtttctctcattctttgaatttttcttaatattctagattatacatacatccgcagatttaggaaactttcatagagtgtaatcttttctttctgtaaaaatatattttacttgtagcaaa

SEQ ID NO: 138 - protein, 162 aa, Arabidopsis thaliana
MVAISEIKSTVDVTAANCLMLLSRVGQENVDGGDQKRVFTCKTCLKQFHSFQALGGHRASHKKPNNDALSSGLMKKVKTSSHPCPICGVEFPMGQALGGHMRRHRNESGAAGGALVTRALLPEPTVTTLKKSSSGKRVACLDLSLGMVDNLNLKLELGRTVY

SEQ ID NO: 139 - DNA, 628 bp, Arabidopsis thaliana
cctagaagtcactaagtcgattcaaaatggttgcgagaagtgaggaaattgtgatagtggaagaagatacgactgcgaaatgtttgatgttgttatcaagagtcggagaatgcggcggcggctgcgggggagatgaacgtgttttccgatgcaagacttgtcttaaagagttctcatcgtttcaagctttgggaggtcatcgtgcaagccacaagaaacttatcaacagtgacaatccatcacttcttggatccttgtccaacaagaaaactaaaacgtctcatccttgtccgatatgtggagtgaagtttccgatgggacaagctcttggtggtcacatgaggagacataggaacgagaaagtctcaggctcgttggttacacgttcttttctaccggagacgacgacggtgacggctttgaagaaatttagtagtgggaagagagtggcttgtttggatttggacttagattcgatggagagtttggtcaattggaagttggagttgggaagaacgatttcttggagttaagtttttgggttgtatacagtttcacatgattttgtaatctttgttgatccaattatcgtaccgatcgatgtgaatattattttgatacaataaaa

SEQ ID NO: 140 - protein, 168 aa, Arabidopsis thaliana
MVARSEEIVIVEEDTTAKCLMLLSRVGECGGGCGGDERVFRCKTCLKEFSSFQALGGHRASHKKLINSDNPSLLGSLSNKKTKTSHPCPICGVKFPMGQALGGHMRRHRNEKVSGSLVTRSFLPETTTVTALKKFSSGKRVACLDLDLDSMESLVNWKLELGRTISWS

SEQ ID NO: 141 - DNA, 2136 bp, Arabidopsis thaliana
gaattaaaaggtttaacctttacctttttttcccttcactatcgataattgatcttctctttcggctgaatataaatctgaaaaaatggatcaagatcagcatcctcagtacggtataccggagctccggcagctcatgaaaggcggaggaaggacgactactacaacaccgtctacttcttctcattttccctctgatttcttcggttttaaccttgctccggtgcagccaccgccacaccgtcttcatcagttcactactgatcaagatatgggtttcttgccacgtggcatacatggattgggtggaggttcttcaacggctggaaataacagtaacttaaacgcgagtactagtggtggaggagttgggtttagtgggtttcttgacggtggtggtttcggcagcggagtaggaggagacggtggaggaactggaaggtggccgagacaagaaaccctaactctgttggaaattagatctcgtcttgatcataaattcaaagaagctaatcataaaggacctctttgggatgaagtttctaggattatgtccgaggaacatggataccaaaggagtgggaagaaatgcagagagaagtttgagaatctgtacaaatactatagtaagactaaagaaggcgaagccggaagacaagacggaaaacatcacagatttttccgccagctccaagcgctatacggggattctaataacttggtttcttgtcccaatcataacacgcagttcatgagcagtgctcttcatggtttccatactcaaaaccctatgaacgttgctacaacaacgtccaacatccataacgttgatagtgttcatggttttcatcaaagccttagtctttctaacaactacaactcctccgagcttgagctgatgacttcctcttcggaagggaatgattctagtagtagaaggaaaaagaggagttggaaagcgaagataaaggagttcattgatacgaacatgaaaaggttgatagagaggcaagatgtttggcttgagaagttgacaaaggttattgaagacaaagaggaacaacggatgatgaaagaagaggaatggaggaagattgaagctgcaaggattgataaagagcatttgttttgggctaaagagagggcgaggatggaagctagggatgttgcggtgattgaggcattgcaatacttgacaggaaagccattgataaagccgctgtgttcatccccggaagagaggacaaatggtaataatgagatccgaaacaatagtgagacacagaatgagaatggaagcgatcaaacgatgactaacaatgtttgtgttaaaggaagtagtagctgctggggtgagcaagagattttaaagcttatggagataagaacgagcatggactcgacctttcaagagatattaggagggtgctcggatgagtttctatgggaggaaatcgcagcgaagttgattcagttagggtttgatcagagaagtgccttattatgcaaggaaaagtgggaatggataagcaatggaatgaggaaagaaaagaagcaaatcaacaagaaaagaaaggataattcgtccagctgcggcgtgtactacccgagaaacgaagaaaatccaatctacaataatcgagaaagtggatataatgataatgatccgcatcaaatcaacgaacaaggcaatgtaggttcttcaacatcaaacgcaaacgcaaacgcaaacgtaaccactggaaatccgagcggtgcaatggctgctagtacaaactgcttcccgttcttcatgggagatggagatcagaatttgtgggagagttatggtttgaggctcagtaaagaagagaatcagtaagtaatttctcttaatgaagaagaagaaggtaatcatgtggttaactaattcttttgagttagctatatatgagataaaccttgacttagctattatatgtcacatgctgcttagaattaagaaatatttgttggggcttaacgaattatatatcagcatatataagatgagagtctaagaattatatcaaattaggctttaaccaacgtacgattatatattatgttttcatgtatttattctgtaagactttttaatatcaatctttctctaaa

SEQ ID NO: 142 - protein, 591 aa, Arabidopsis thaliana
MDQDQHPQYGIPELRQLMKGGGRTTTTTPSTSSHFPSDFFGFNLAPVQPPPHRLHQFTTDQDMGFLPRGIHGLGGGSSTAGNNSNLNASTSGGGVGFSGFLDGGGFGSGVGGDGGGTGRWPRQETLTLLEIRSRLDHKFKEANHKGPLWDEVSRIMSEEHGYQRSGKKCREKFENLYKYYSKTKEGEAGRQDGKHHRFFRQLQALYGDSNNLVSCPNHNTQFMSSALHGFHTQNPMNVATTTSNIHNVDSVHGFHQSLSLSNNYNSSELELMTSSSEGNDSSSRRKKRSWKAKIKEFIDTNMKRLIERQDVWLEKLTKVIEDKEEQRMMKEEEWRKIEAARIDKEHLFWAKERARMEARDVAVIEALQYLTGKPLIKPLCSSPEERTNGNNEIRNNSETQNENGSDQTMTNNVCVKGSSSCWGEQEILKLMEIRTSMDSTFQEILGGCSDEFLWEEIAAKLIQLGFDQRSALLCKEKWEWISNGMRKEKKQINKKRKDNSSSCGVYYPRNEENPIYNNRESGYNDNDPHQINEQGNVGSSTSNANANANVTTGNPSGAMAASTNCFPFFMGDGDQNLWESYGLRLSKEENQ

SEQ ID NO: 143 - DNA, 1571 bp, Arabidopsis thaliana
aggaacagtgaaaggttcggttttttgggtttcgatctgataatcaacaagaaaaaagggtttgatttatgtcggctgggtttgaatcgactgtgattttgtctttgattcatatctcttctccgatttcatcatcatcttccccatcatcgtcgtctttgaaatcttgtcttctcaacgctcttcacttctgctgtaataagcagaggcttgttctggagactccttctctttccatgcgcttaagacccaaaaggacttgttctagtgttgaagtctttgggggttttcacataaagcagcaaaagttttcttttttcatagttcgctgagagttttgagttttgataccaaaaaagttttgaccttttagagtgattttttgttctttctgttttctgggtatttttgaggagtgggtttaacaatggttgcgattagaaaggaacagtctttgagtggtgttagtagcgagattaagaagagagctaagagaaacactctatcgtcccttcctcaagaaacccaacctttgaggaaagtccgtattattgtgaatgatccttatgctactgatgattcctctagtgatgaggaagagcttaaggttcctaagccaaggaaaatgaaacgtatcgttcgtgagattaactttccttctatggaagtttctgaacagccttctgagagttcttctcaggacagtactaaaactgatggcaagatagctgtgtcagcttctcctgctgttcctaggaagaagcctgttggtgttaggcaaaggaaatgggggaaatgggctgctgagattagagatcctattaagaaaactaggacttggttgggtacttttgatactcttgaagaagctgctaaagcttatgatgctaagaagcttgagtttgatgctattgttgctggaaatgtgtccactactaaacgtgatgtttcttcatctgagactagccaatgctctcgttcttcacctgttgttcctgttgagcaagatgacacttctgcatcagctctcacttgtgtcaacaaccctgatgacgtctcgaccgttgctccaactgctccaactccaaatgttcctgctggtggaaacaaggaaacgttgttcgatttcgactttactaatctacagatccctgattttggtttcttggcagaggagcaacaagacctagacttcgattgtttcctcgcggatgatcagtttgatgatttcggcttgcttgatgacattcaaggattcgaagataacggtccaagtgcgttaccagatttcgactttgcggatgttgaagatcttcagctagctgactctagtttcggtttccttgatcaacttgctcctatcaacatctcttgcccattaaaaagttttgcagcttcataggatcttgcttagtaatgttaagtgagaagagtgttttgttttttcgtttatgctttagtaatttaagacatacaaaagtgtgtgttccggattgtagtaagatcttaagacataaagccgggttttgcaattaggaatcgagttttaatgaagttttagtttatgtttg

SEQ ID NO: 144 - protein, 324 aa, Arabidopsis thaliana
MVAIRKEQSLSGVSSEIKKRAKRNTLSSLPQETQPLRKVRIIVNDPYATDDSSSDEEELKVPKPRKMKRIVREINFPSMEVSEQPSESSSQDSTKTDGKIAVSASPAVPRKKPVGVRQRKWGKWAAEIRDPIKKTRTWLGTFDTLEEAAKAYDAKKLEFDAIVAGNVSTTKRDVSSSETSQCSRSSPVVPVEQDDTSASALTCVNNPDDVSTVAPTAPTPNVPAGGNKETLFDFDFTNLQIPDFGFLAEEQQDLDFDCFLADDQFDDFGLLDDIQGFEDNGPSALPDFDFADVEDLQLADSSFGFLDQLAPINISCPLKSFAAS

SEQ ID NO: 145 - DNA, 1144 bp, Arabidopsis thaliana
cgtcgacctcccaacactaactccatgtttataacggaaaaacaagtgtggatggatgagatcgtcgcaagaagagcttcttcttcttgggacttccctttcaacgacattaatattcatcagcatcatcatcgtcactgcaacacaagtcatgagtttgaaatcttgaagagtcctcttggagatgtagcggttcacgaagaagagagtaataataataaccctaatttcagtaacagcgagagtggtaagaaggagacaacagatagtggtcagtcttggtcctcgtcgtcttcaaaaccatcggtcttggggagaggacattggagaccagctgaagatgttaaactcaaagagcttgtctccatttacggcccacaaaactggaacctcatagctgaaaagcttcaaggaagatctgggaagagctgtagactacgatggtttaaccaattggacccgaggataaaccgaagagctttcacagaagaagaagaggagaggctgatgcaagcacataggctttatggtaacaaatgggcaatgattgcgaggcttttccctggtagaactgataattcagtgaagaaccattggcatgttgtcatggctcgtaagtatagagaacactcttctgcttaccgtaggagaaagcttatgagtaataatccacttaaacctcacctcaccaataatcatcatcctaaccctaaccctaattaccactcttttatctccactaatcattacttcgctcagcctttccccgagtttaatttgactcatcacctggttaataatgcccctatcacgagtgaccataaccagcttgtgttgcctttccattgctttcaaggttatgagaacaatgaacctccgatggttgtgagtatgtttggcaaccaaatgatggtcggcgataacgttggtgccacgtcagacgcgttatgcaatattccgcacattgaccctagtaaccaagagaaaccggagccaaatgatgcaatgcattggatcggaatggacgcggtagatgaggaggtgttcgaaaaggctaagcagcaaccacattttttcgattttcttggcttggggacggcgtgaatgttgaacaaattggtgttaatcagataacgacagtggc

SEQ ID NO: 146 - protein, 359 aa, Arabidopsis thaliana
MFITEKQVWMDEIVARRASSSWDFPFNDINIHQHHHRHCNTSHEFEILKSPLGDVAVHEEESNNNNPNFSNSESGKKETTDSGQSWSSSSSKPSVLGRGHWRPAEDVKLKELVSIYGPQNWNLIAEKLQGRSGKSCRLRWFNQLDPRINRRAFTEEEEERLMQAHRLYGNKWAMIARLFPGRTDNSVKNHWHVVMARKYREHSSAYRRRKLMSNNPLKPHLTNNHHPNPNPNYHSFISTNHYFAQPFPEFNLTHHLVNNAPITSDHNQLVLPFHCFQGYENNEPPMVVSMFGNQMMVGDNVGATSDALCNIPHIDPSNQEKPEPNDAMHWIGMDAVDEEVFEKAKQQPHFFDFLGLGTA

SEQ ID NO: 147 - DNA, 2031 bp, Arabidopsis thaliana
gctcgttttcaaattaaaaacagggagaaatttggaaattccagtacgacgggagataaaacctaacatacgccatggtgaccgttatctaaactacgccaaaatatttgaagtgtcgtcgtttcataataaaacgcaaacaaaaacccactcccactttctcctttccaaaaaaagaactctcgccactttctctgctcttttctttctctctctctttcttgttttcgccggcgatcatggagaaaagcggcttctctcccgtcggtctaagggttcttgtcgtagacgatgatccaacttggctcaagattctcgagaaaatgctcaagaagtgttcttacgaagtaacgacctgtggattagctagagaggctttgaggttgctgagggagcgtaaagatggatatgatatcgtgatcagcgatgtgaacatgcctgacatggatggtttcaagcttcttgagcatgttggtcttgaattagacctccctgtaataatgatgtcggtggacggcgaaacaagccgagtgatgaagggagtgcacacgggagcttgtgattacctcttgaagccgataagaatgaaggagttaaagattatatggcaacatgttctgagaaagaagcttcaagaagtgagagatatcgaaggctgtggatacgaaggaggagcggattggatcactcgatacgatgaagcacattttcttggaggtggtgaagatgtttcttttgggaaaaagagaaaagactttgactttgagaagaagcttcttcaagatgagagtgatccatcatcttcttcttccaagaaagctagagttgtttggtcttttgagcttcatcataagtttgtcaacgccgttaaccaaatcggatgcgatcacaaagctggtcccaagaagatattggatctcatgaatgttccatggctcactagagaaaatgttgcaagccaccttcagaaatatagactttacctgagcagattagagaaaggaaaggagctcaagtgttattcaggtggcgtgaagaatgcggattcatctccaaaagatgtcgaagtgaattcaggctaccaaagccctgggaggagcagctatgtattctctggaggaaattctctgatccaaaaagcaacagagattgatccaaagccacttgcttcagcttctttgtctgaccccaacaccgatgtgatcatgcctccgaaaacaaaaaagacgcgtataggatttgatcctcccatttcctcctctgcgtttgactctctgcttccttggaatgatgttccagaggtccttgaatcgaagccggttctgtatgagaatagctttctccagcaacaaccattgccaagtcaaagttcctatgttgcaatttctgcaccatctctcatggaggaggaaatgaagcctccttatgagacaccagcaggaggcagtagtgtgaatgcagatgagtttctcatgccacaagacaagatccctactgtaacccttcaagatttggatccctctgccatgaagctgcaggagttcaacacagaaggcgattctgaagaagcttgaactggggaacttccagaatcacatcattctgtttctttagacactgacttagacttgacttggcttcaaggcgagcgtttcttgcaaacaccgactccagtttcaagatacagtagtagcccatcactcctatctgagctcccagcccaccttaattggtatggaaatgagcggctgcctgaccctgacgagtattccttcatggtagaccaaggtttattcatatcttaaccttgttccaataacttcttttcgtatattggttggtgtaatgcagaaagattttgtgggtatacctgaaaataatcttgctttcccaagaaccttccatgatcggatgcattgtacaataatccacgagtgtcgtaggctaattacaccaaacaggttgatgacagtgataaggccacatgtttcacaccgtcgcttaagatctttactgtcacctggaaggaaa

SEQ ID NO: 148 - protein, 444 aa, Arabidopsis thaliana
MEKSGFSPVGLRVLVVDDDPTWLKILEKMLKKCSYEVTTCGLAREALRLLRERKDGYDIVISDVNMPDMDGFKLLEHVGLELDLPVIMMSVDGETSRVMKGVHTGACDYLLKPIRMKELKIIWQHVLRKKLQEVRDIEGCGYEGGADWITRYDEAHFLGGGEDVSFGKKRKDFDFEKKLLQDESDPSSSSSKKARVVWSFELHHKFVNAVNQIGCDHKAGPKKILDLMNVPWLTRENVASHLQKYRLYLSRLEKGKELKCYSGGVKNADSSPKDVEVNSGYQSPGRSSYVFSGGNSLIQKATEIDPKPLASASLSDPNTDVIMPPKTKKTRIGFDPPISSSAFDSLLPWNDVPEVLESKPVLYENSFLQQQPLPSQSSYVAISAPSLMEEEMKPPYETPAGGSSVNADEFLMPQDKIPTVTLQDLDPSAMKLQEFNTEGDSEEA

SEQ ID NO: 149 - DNA, 974 bp, Arabidopsis thaliana
ccccccgacctgcctctacagagacctgaagattccagaaccccacctgatcaaaaataacatggaacttaacagatctgaagcagacgaagcaaaggccgagaccactcccaccggtggagccaccagctcagccacagcctctggctcttcctccggacgtcgtccacgtggtcgtcctgcaggttccaaaaacaaacccaaacctccgacgattataactagagatagtcctaacgtccttagatcacacgttcttgaagtcacctccggttcggacatatccgaggcagtctccacctacgccactcgtcgcggctgcggcgtttgcattataagcggcacgggtgcggtcactaacgtcacgatacggcaacctgcggctccggctggtggaggtgtgattaccctgcatggtcggtttgacattttgtctttgaccggtactgcgcttccaccgcctgcaccaccgggagcaggaggtttgacggtgtatctagccggaggtcaaggacaagttgtaggagggaatgtggctggttcgttaattgcttcgggaccggtagtgttgatggctgcttcttttgcaaacgcagtttatgataggttaccgattgaagaggaagaaaccccaccgccgagaaccaccggggtgcagcagcagcagccggaggcgtctcagtcgtcggaggttacggggagtggggcccaggcgtgtgagtcaaacctccaaggtggaaatggtggaggaggtgttgctttctacaatcttggaatgaatatgaacaattttcaattctccgggggagatatttacggtatgagcggcggtagcggaggaggtggtggcggtgcgactagacccgcgttttagagttttagcgttttggtgacaccttttgttgcgtttgcgtgtttgacctcaaactactaggctactagctatagcggttgcgaaatgcgaatattaggtt

SEQ ID NO: 150 - protein, 270 aa, Arabidopsis thaliana
MELNRSEADEAKAETTPTGGATSSATASGSSSGRRPRGRPAGSKNKPKPPTIITRDSPNVLRSHVLEVTSGSDISEAVSTYATRRGCGVCIISGTGAVTNVTIRQPAAPAGGGVITLHGRFDILSLTGTALPPPAPPGAGGLTVYLAGGQGQVVGGNVAGSLIASGPVVLMAASFANAVYDRLPIEEEETPPPRTTGVQQQQPEASQSSEVTGSGAQACESNLQGGNGGGGVAFYNLGMNMNNFQFSGGDIYGMSGGSGGGGGGATRPAF

SEQ ID NO: 151 - DNA, 3323 bp, Arabidopsis thaliana
cttctctagcgtcactcttcttcttcattggtcggtagaataaggccaaggaagggatcagttttaagttttgtttcattctttttgtagtggagaaaaagagtttttgaaaatcaaaacaacaaaaaatgccgattaggcaaatgaaagatagctctgagactcacttagttatcaaaacccaacctttaaagcaccacaatccaaaaaccgttcaaaacggtaaaatccctcctccttctccttctccggtgacggtgactactccggcgacggttactcagagtcaagcttcttcaccttcaccaccgtcaaagaatcgtagccggaggagaaaccgtggtggaagaaaatctgatcaaggagatgtttgtatgagacctagctctcgtcctcgtaaaccgccaccgccaagtcaaaccacttcctccgccgtctccgtcgccaccgccggtgagattgtcgctgtgaatcatcagatgcagatgggtgttcgtaaaaactcaaactttgctccaagacctggatttggaacacttggaactaaatgcattgttaaagctaaccactttctcgctgatttgcctaccaaggatttgaatcagtatgatgttacaattactcctgaagtgtcatcaaagagtgttaacagagctataattgctgagttagttagactttacaaagagtctgatctcgggaggagacttccggcttacgatggccggaaaagtctttacactgctggagaacttccttttacttggaaggagttcagtgttaagattgttgatgaagatgacggtatcatcaatggccctaaaagggagagatcatataaggtggcaatcaagtttgttgcacgggcaaatatgcatcacttaggcgagtttctagctggtaaacgggcagattgtccgcaagaggcggtgcagattcttgatattgtactcagggagttgtcggttaagaggttttgtcccgttggaagatctttcttttcgcctgatattaaaacaccgcagcgactcggtgaagggttagagtcatggtgtgggttttaccagagtattagaccaactcaaatgggtttatcactaaatatcgatatggcttcagctgcattcatcgagcctcttccagtgatagagtttgtagcacagcttcttggaaaggatgtcttgtcgaagccattgtcggattctgatcgcgtcaagattaagaagggtcttagaggagtgaaagtagaggttactcacagagcgaatgtaagaaggaaataccgtgttgcgggtttaacaactcaaccaacaagagagctaatgtttccagtagatgagaactgtactatgaagtcagttattgagtatttccaagagatgtatggattcacgatccagcacacgcatttgccatgtctccaagttggaaaccaaaagaaggcaagctatttgccgatggaggcatgcaaaattgtcgagggacaacggtacacgaaaaggttgaatgagaagcagattactgctctcttgaaagttacatgccaaagggccgagggacagagaaacgatattttgcggactgtccaacacaacgcatatgatcaagatccatatgcaaaggagtttggcatgaacataagcgaaaagttagcttctgttgaagctcgtattcttccagctccatggcttaagtatcacgagaacgggaaagaaaaagattgtctcccgcaagttggtcagtggaatatgatgaacaagaaaatgatcaacgggatgactgtgagcagatgggcctgtgttaacttctcacgcagcgttcaagaaaacgttgctcgtggattttgtaatgaacttggtcagatgtgtgaagtctcaggcatggagtttaatccagaacccgtgataccaatatatagtgcgaggcccgatcaagtcgagaaagctctaaagcatgtttatcacacttcaatgaacaaaaccaaaggcaaagagttagagcttctgctggcaatattacctgataacaacggttcactttatggtgatcttaagagaatctgtgaaaccgagcttggtttgatatctcaatgttgtctcacaaaacatgtgttcaagattagcaaacagtatctggcagatgtatcccttaaaatcaacgtaaagatgggaggaaggaacacagttctagtagacgccataagctgtagaattccactggttagcgatataccgacaatcatttttggcgcagacgtgactcacccagagaacggggaagagtcaagcccttcaatcgctgctgttgttgcttctcaagactggcctgaagtgacaaaatatgcgggtttagtttgtgctcaagctcacaggcaagaacttatacaagatttgtataaaacatggcaagatcctgttcgcggtactgttagtggcggtatgatcagggaccttcttatctcatttagaaaagcaacagggcaaaaaccgcttcgaattatcttttatcgtgatggagtaagcgaagggcaattctatcaagttttactctatgagttggatgcaattcgaaaggcttgtgcatcgcttgaaccgaattatcagccaccggtgacattcatagttgtacagaagcgtcaccacactcgtttgtttgctaataatcaccgagacaaaaacagtactgaccgaagcggaaatatcttaccaggtactgtagttgacactaaaatatgtcatccaactgaattcgacttctacctttgtagccatgcgggtattcagggaacaagcaggcctgcacattaccatgttctttgggacgagaacaatttcacagcagatggtattcaatctctgactaacaatctctgttatacctatgcgcggtgcactcggtcggtctctatagttcctccagcgtattatgctcatcttgcagcatttcgagcacgtttctacctggaacctgagataatgcaagacaacggatcaccgggtaaaaagaacacgaaaacaacaactgtcggagacgtaggtgtgaagcctttaccagccttgaaggagaatgtgaagagagtaatgttctactgctaaaaatccaaacattccttaatcagttttaataagtagtttggttgtttgcttgtagttcggctttagatttaccaatgtttttcttatgtaaattttgtcggtttggtttaagcctttaggaattagtgtattagggtttttctaaagttgtactttagctgatgataacgttgatgcagtgactttgttaaaacctcctcttctacagtagtgtttacgtcgttcctc

SEQ ID NO: 152 - protein, 988 aa, Arabidopsis thaliana
MPIRQMKDSSETHLVIKTQPLKHHNPKTVQNGKIPPPSPSPVTVTTPATVTQSQASSPSPPSKNRSRRRNRGGRKSDQGDVCMRPSSRPRKPPPPSQTTSSAVSVATAGEIVAVNHQMQMGVRKNSNFAPRPGFGTLGTKCIVKANHFLADLPTKDLNQYDVTITPEVSSKSVNRAIIAELVRLYKESDLGRRLPAYDGRKSLYTAGELPFTWKEFSVKIVDEDDGIINGPKRERSYKVAIKFVARANMHHLGEFLAGKRADCPQEAVQILDIVLRELSVKRFCPVGRSFFSPDIKTPQRLGEGLESWCGFYQSIRPTQMGLSLNIDMASAAFIEPLPVIEFVAQLLGKDVLSKPLSDSDRVKIKKGLRGVKVEVTHRANVRRKYRVAGLTTQPTRELMFPVDENCTMKSVIEYFQEMYGFTIQHTHLPCLQVGNQKKASYLPMEACKIVEGQRYTKRLNEKQITALLKVTCQRAEGQRNDILRTVQHNAYDQDPYAKEFGMNISEKLASVEARILPAPWLKYHENGKEKDCLPQVGQWNMMNKKMINGMTVSRWACVNFSRSVQENVARGFCNELGQMCEVSGMEFNPEPVIPIYSARPDQVEKALKHVYHTSMNKTKGKELELLLAILPDNNGSLYGDLKRICETELGLISQCCLTKHVFKISKQYLADVSLKINVKMGGRNTVLVDAISCRIPLVSDIPTIIFGADVTHPENGEESSPSIAAVVASQDWPEVTKYAGLVCAQAHRQELIQDLYKTWQDPVRGTVSGGMIRDLLISFRKATGQKPLRIIFYRDGVSEGQFYQVLLYELDAIRKACASLEPNYQPPVTFIVVQKRHHTRLFANNHRDKNSTDRSGNILPGTVVDTKICHPTEFDFYLCSHAGIQGTSRPAHYHVLWDENNFTADGIQSLTNNLCYTYARCTRSVSIVPPAYYAHLAAFRARFYLEPEIMQDNGSPGKKNTKTTTVGDVGVKPLPALKENVKRVMFYC

SEQ ID NO: 153 - DNA, 1072 bp, Arabidopsis thaliana
  misc_feature (46)..(63): n=a,t,c or g
aagtagagaataataatcacatcaagattgtttataaccctccccntaatcaccttcttantnaccaccctctccggctctcaacagaacaacaacaaaaaaacagcttccgttgtcctgttccggcgaaatcggacggtcgagatcaatcatgcatcgtagagcagcaattcaagaatcggatgacgaagaagatgagacttacaacgacgtcgttcctgaatctccttcttcttgtgaagactcaaagatctcaaaaccaactccaaagaaaaggaggaacgtagagaagagagttgtctcagttccgatagctgacgtggaaggatctaagagcagaggcgaagtatatccaccgtccgattcatgggcctggagaaagtacggacaaaaaccgatcaaaggctcgccttatcccaggggatattacagatgtagtagctcaaaaggatgtccggcgaggaagcaggtggagagaagccgtgtggacccttctaagcttatgattacttacgcctgcgaccacaatcaccctttcccttcctcctccgctaacaccaaatcccaccaccgctcctccgtcgtcctcaaaaccgcaaagaaagaggaagaatacgaagaggaggaagaagaactaaccgtcaccgccgcagaggaaccaccggcgggacttgatctaagccacgtagactcaccgttgctattaggcggctgctacagcgaaatcggagagttcgggtggttctacgacgcgtcgatctcatcatcatctggttcttcgaatttcctcgacgtaactctagagagaggtttttcagtaggccaagaggaagatgagtctttgttcggtgatctcggtgatttacctgattgcgcctccgtgttccgccgtgggactgttgcgacggaggagcaacatcgaagatgtgattttggcgccattcctttctgtgatagttctagatgagtttgtgtgtgtagccaaaaccaaaagaaaaaaacacaatttttttattttccactgtaaaggtgtatcaatggtggattcatttttttaaaaaaaaaaaaaaaa

SEQ ID NO: 154 - protein, 271 aa, Arabidopsis thaliana
MHRRAAIQESDDEEDETYNDVVPESPSSCEDSKISKPTPKKRRNVEKRVVSVPIADVEGSKSRGEVYPPSDSWAWRKYGQKPIKGSPYPRGYYRCSSSKGCPARKQVERSRVDPSKLMITYACDHNHPFPSSSANTKSHHRSSVVLKTAKKEEEYEEEEEELTVTAAEEPPAGLDLSHVDSPLLLGGCYSEIGEFGWFYDASISSSSGSSNFLDVTLERGFSVGQEEDESLFGDLGDLPDCASVFRRGTVATEEQHRRCDFGAIPFCDSSR

SEQ ID NO: 155 - DNA, 1166 bp, Arabidopsis thaliana
aacaattctctctctctttattcttcttcttcagcttcagatttcagatcttaaatcttcaagtcttcttcttcttcttctgcaaccatggctatgcaggaacgttgtgagagtttatgttctgatgaacttatatcttcctcagatgccttttacctcaagacaagaaagccttataccatcactaaacaaagagagaaatggacagaagcagagcatgagaagtttgtagaagcattgaaactctatggcagagcttggagacgaatcgaagaacatgttggaacaaaaactgcagttcagattcgaagccatgcgcagaagttctttactaaggttgctcgcgattttggtgttagctctgagtccattgagatcccgcctccaaggccaaagagaaagccgatgcatccttaccctagaaagcttgtgattcctgatgcaaaagagatggtatacgctgaactaaccggatccaagctgattcaggatgaagataaccgatctccaacatcggttttatcagctcatggctcagatggattaggttccattggttcaaattcacctaactcttcttcagctgagttatcatctcacacagaggaatcattgtctctagaagcagagaccaaacagagccttaagctctttggaaaaacttttgtagttggtgattacaactcttcaatgagttgtgatgattctgaagatggcaagaagaagctatactcagaaacacagtctcttcaatgttcttcttctacttcagaaaacgctgaaacagaagtggtagtgtcggagttcaaaagaagtgagagatcagctttctctcagttaaaatcgtcggtgactgagatgaacaacatgagagggttcatgccttacaaaaagagagtaaaggtggaagaaaacattgacaatgtaaaattatcatatcctttgtggtgaagtgttcgtttgtgtcaagtcagttgtgtaaactcttttgatctcaacatcagattatgtgtataatgtcagagtattagggaaagtttttttggattagattcgtaagatcactccaaagtttcgtgtctttccatataaccagttagaaattgagatccttgtacttaaacatttttatttgatcaatcaaatcttcttgatgaaaaaaaaaa

SEQ ID NO: 156 - protein, 287 aa, Arabidopsis thaliana
MAMQERCESLCSDELISSSDAFYLKTRKPYTITKQREKWTEAEHEKFVEALKLYGRAWRRIEEHVGTKTAVQIRSHAQKFFTKVARDFGVSSESIEIPPPRPKRKPMHPYPRKLVIPDAKEMVYAELTGSKLIQDEDNRSPTSVLSAHGSDGLGSIGSNSPNSSSAELSSHTEESLSLEAETKQSLKLFGKTFVVGDYNSSMSCDDSEDGKKKLYSETQSLQCSSSTSENAETEVVVSEFKRSERSAFSQLKSSVTEMNNMRGFMPYKKRVKVEENIDNVKLSYPLW

SEQ ID NO: 157 - DNA, 1371 bp, Arabidopsis thaliana
atttattaagcatcaatgagagaacttcagagctgggtttgagttctgtccaataatacataaccacgttatcatttttgtcctttactatctcattacactcttctgttattcgcccaattcttacagtcattactctctatagggctcgagcggccgcccgggcaggtttctatgcagatggttcacacttcccgctccattgcccagattgggttcggtgttaagtcgcaattagtactcactatagggctcgagcggccgcccgggcaggtaaaagatcaaacaatgtctaaagaagctgagatgtcgatcgcggtgtcggctttgttccctggttttagattctctcctactgatgttgaacttatctcgtactatcttcgtcgtaaaatcgatggtgatgagaactctgttgctgtgattgctgaggtcgagatttacaagttcgagccgtgggacttgccagaggaatcgaaactgaaatcggagaacgagtggttttacttctgcgcgagggggaggaagtacccgcacgggtcacaaagccggcgagccacacagctaggatattggaaagcgaccggtaaagagcggagtgttaaatccgggaaccaagttgttggaaccaagagaacgcttgtatttcatatcggtcgggctcctcgtggcgagagaacggagtggattatgcatgaatactgcatccatggagccccacaggatgcattagtggtgtgccggttaagaaaaaatgctgattttcgggctagttcgacccaaaaaattgaggatggtgttgtgcaagacgatggctacgttggccaaagaggtggtttggacaaggaggacaaatcctactatgaatctgagcatcagataccaaatggtgacatcgcagaatcatcaaatgttgttgaggatcaggccgataccgatgatgattgttacgccgagattctgaacgatgatataataaagctcgacgaagaagcgttgaaagctagccaagcgtttcgaccaactaatccaactcatcaagaaacaatatcaagcgagtcatcgagtaagaggtcaaaatgtggtataaaaaaagaatcaacggaaacaatgaattgttacgctttgttcaggatcaagaacgttgccggaaccgactccagctggagattcccgaacccgttcaaaatcaagaaagatgatagccagagattgatgaagaatgttctggccactactgttttcttggctatcttattttctttcttttggactgtattaatagctaggaactaaagctagttacgacatacatattatttatacataaataaatatagtattttgtctatggcaaaaaaaaaaaaaaaa

SEQ ID NO: 158 - protein, 373 aa, Arabidopsis thaliana
MQMVHTSRSIAQIGFGVKSQLVLTIGLERPPGQVKDQTMSKEAEMSIAVSALFPGFRFSPTDVELISYYLRRKIDGDENSVAVIAEVEIYKFEPWDLPEESKLKSENEWFYFCARGRKYPHGSQSRRATQLGYWKATGKERSVKSGNQVVGTKRTLVFHIGRAPRGERTEWIMHEYCIHGAPQDALVVCRLRKNADFRASSTQKIEDGVVQDDGYVGQRGGLDKEDKSYYESEHQIPNGDIAESSNVVEDQADTDDDCYAEILNDDIIKLDEEALKASQAFRPTNPTHQETISSESSSKRSKCGIKKESTETMNCYALFRIKNVAGTDSSWRFPNPFKIKKDDSQRLMKNVLATTVFLAILFSFFWTVLIARN

SEQ ID NO: 159 - DNA, 1424 bp, Arabidopsis thaliana
tcgacagagttgtgttgggcgtggaacttggactagttccacatatcaggttatatagatcttctctttcaacttctgattcgtccagaagctttcctaatctgagatctgacatggaacaccaaggttggagttttgaggagaattatagtttgtccactaatagaagatctatcaggccacaagatgaactagtggagttattatggcgagatggacaagtggttctgcagagccaaactcatagagaacaaacccaaacccagaaacaagatcatcatgaagaagccctaagatccagcacctttcttgaagatcaagaaactgtctcttggatccaataccctccagatgaagacccattcgaacccgacgacttctcctcccacttcttctcaaccatggatcccctccagagaccaacctcagagacggttaagcctaagtccagtcctgaacctcctcaagtcatggttaagcctaaggcctgtcctgaccctcctcctcaagtcatgcctcctccaaaatttaggttaacaaattcatcatcggggattagggaaacagaaatggaacagtactcggtaacgaccgttggacctagccattgcggaagcaacccatcacagaacgatctcgatgtctcaatgagtcatgatcgaagcaaaaacatagaagaaaagcttaatccgaacgcaagttcctcatcaggtggctcctctggttgcagctttggcaaagatatcaaagaaatggctagtggaagatgcatcacaaccgaccgtaagagaaaacgtataaatcacactgacgaatctgtatctctatcagatgcaatcggtaacaagtcgaaccaacgatcaggatcaaaccgaaggagtcgagcagctgaagttcataatctctccgaaaggaggaggagagataggatcaatgagagaatgaaggctttgcaagaactaatacctcactgcagtaaaactgataaagcttcgattttagacgaagccatagattatttgaaatcacttcagttacagcttcaagtgatgtggatggggagtggaatggcggcggcggcggcttcggctccgatgatgttccccggagttcaacctcagcagttcatacgtcagatacagagcccggtacagttacctcgatttccggttatggatcagtctgcaattcagaacaatcccggtttagtttgccaaaacccggtacaaaaccagatcatctccgaccggtttgctagatacatcggtgggttcccacacatgcaggccgcgactcagatgcagccgatggagatgttgagatttagttcaccggcgggacagcaaagtcaacaaccgtcgtctgtgccgacgaagaccaccgacggttctcgtttggaccactaggttggtgagccactttgc

SEQ ID NO: 160 - protein, 430 aa, Arabidopsis thaliana
MEHQGWSFEENYSLSTNRRSIRPQDELVELLWRDGQVVLQSQTHREQTQTQKQDHHEEALRSSTFLEDQETVSWIQYPPDEDPFEPDDFSSHFFSTMDPLQRPTSETVKPKSSPEPPQVMVKPKACPDPPPQVMPPPKFRLTNSSSGIRETEMEQYSVTTVGPSHCGSNPSQNDLDVSMSHDRSKNIEEKLNPNASSSSGGSSGCSFGKDIKEMASGRCITTDRKRKRINHTDESVSLSDAIGNKSNQRSGSNRRSRAAEVHNLSERRRRDRINERMKALQELIPHCSKTDKASILDEAIDYLKSLQLQLQVMWMGSGMAAAAASAPMMFPGVQPQQFIRQIQSPVQLPRFPVMDQSAIQNNPGLVCQNPVQNQIISDRFARYIGGFPHMQAATQMQPMEMLRFSSPAGQQSQQPSSVPTKTTDGSRLDH

SEQ ID NO: 161 - DNA, 2511 bp, Arabidopsis thaliana
atggcaatgtcttgcaaggatggtaagttgggatgtttggataatgggaagtatgtgaggtatacacctgaacaagttgaagcacttgagaggctttatcatgactgtcctaaaccgagttctattcgccgtcagcagttgatcagagagtgtcctattctctctaacattgagcctaaacagatcaaagtgtggtttcagaaccgaagatgtagagagaaacaaaggaaagaggcttcacggcttcaagctgtgaatcggaagttgacggcaatgaacaagctcttgatggaggagaatgacaggttgcagaagcaagtgtcacagctggtccatgaaaacagctacttccgtcaacatactccaaatccttcactcccagctaaagacacaagctgtgaatcggtggtgacgagtggtcagcaccaattggcatctcaaaatcctcagagagatgctagtcctgcaggacttttgtccattgcagaagaaactttagcagagtttctttcaaaggcaactggaaccgctgttgagtgggttcagatgcctggaatgaagcctggtccggattccattggaatcatcgctatttctcatggttgcactggtgtggcagcacgcgcctgtggcctagtgggtcttgagcctacaagggttgcagagattgtcaaggatcgtccttcgtggttccgcgaatgtcgagctgttgaagttatgaacgtgttgccaactgccaatggtggaaccgttgagctgctttatatgcagctctatgcaccaactacattggccccaccacgcgatttctggctgttacgttacacctctgttttagaagatggcagccttgtggtgtgcgagagatctcttaagagcactcaaaatggtcctagtatgccactggttcagaattttgtgagagcagagatgctttccagtgggtacttgatacggccttgtgatggtggtggctcaatcatacacatagtggatcatatggatttggaggcttgtagcgtgcctgaggtcttgcgcccgctctatgagtcacccaaagtacttgcacagaagacaacaatggcggcactgcgtcagctcaagcaaatagctcaggaggttactcagactaatagtagtgttaatgggtggggacggcgtcctgctgccttaagagctctcagccagaggctaagcagaggcttcaatgaagctgtaaatggtttcactgatgaaggatggtcagtgataggagatagcatggatgatgtcacaatcactgtaaactcttctccagacaagctaatgggtctaaatcttacatttgccaatggctttgctcctgtaagcaatgttgttttatgcgcaaaagcatcaatgcttttacagaatgttcctccggcgatcctgcttcggtttctgagggagcataggtcagaatgggctgacaacaacattgatgcgtatctagcagcagcagttaaagtagggccttgtagtgcccgagttggaggatttggagggcaggttatacttccacttgctcatactattgagcatgaagagtttatggaagtcatcaaattggaaggtcttggtcattcccctgaagatgcaatcgttccaagagatatcttccttcttcaactttgtagcggaatggatgaaaatgctgtaggaacctgtgcggaacttatatttgctccaatcgatgcttcgtttgcggatgatgcacctctgcttccttctggttttcgtattatccctcttgattccgcaaaggaagtatctagcccaaaccgaaccttggatcttgcttcggcactggaaattggttcagctggaacaaaagcctcaactgatcaatcaggaaactccacatgtgcaagatctgtgatgacaatagcatttgagtttggtatcgagagccatatgcaagaacatgtagcatccatggctaggcagtatgttcgaggtatcatatcatcggtgcagagagtagcattggctctttctccttctcatatcagctcacaagttggtctacgcactcctttgggtactcctgaagcccaaacacttgctcgttggatttgccagagttacaggggctacatgggtgttgagctacttaaatcaaacagtgacggcaatgaatctattcttaagaatctttggcatcacactgatgctataatctgctgctcaatgaaggccttgcccgtcttcacatttgcaaaccaggcgggacttgacatgctggagactacattagttgctcttcaagacatctctttagagaagatatttgatgacaatggaagaaagactctttgctctgagttcccacagatcatgcaacagggcttcgcgtgccttcaaggcgggatatgtctctcaagcatggggagaccagtttcgtatgagagagcagttgcttggaaagtactcaatgaagaagaaaatgctcattgcatctgctttgtgttcatcaattggtcctttgtgtga

SEQ ID NO: 162 - protein, 836 aa, Arabidopsis thaliana
MAMSCKDGKLGCLDNGKYVRYTPEQVEALERLYHDCPKPSSIRRQQLIRECPILSNIEPKQIKVWFQNRRCREKQRKEASRLQAVNRKLTAMNKLLMEENDRLQKQVSQLVHENSYFRQHTPNPSLPAKDTSCESVVTSGQHQLASQNPQRDASPAGLLSIAEETLAEFLSKATGTAVEWVQMPGMKPGPDSIGIIAISHGCTGVAARACGLVGLEPTRVAEIVKDRPSWFRECRAVEVMNVLPTANGGTVELLYMQLYAPTTLAPPRDFWLLRYTSVLEDGSLVVCERSLKSTQNGPSMPLVQNFVRAEMLSSGYLIRPCDGGGSIIHIVDHMDLEACSVPEVLRPLYESPKVLAQKTTMAALRQLKQIAQEVTQTNSSVNGWGRRPAALRALSQRLSRGFNEAVNGFTDEGWSVIGDSMDDVTITVNSSPDKLMGLNLTFANGFAPVSNVVLCAKASMLLQNVPPAILLRFLREHRSEWADNNIDAYLAAAVKVGPCSARVGGFGGQVILPLAHTIEHEEFMEVIKLEGLGHSPEDAIVPRDIFLLQLCSGMDENAVGTCAELIFAPIDASFADDAPLLPSGFRIIPLDSAKEVSSPNRTLDLASALEIGSAGTKASTDQSGNSTCARSVMTIAFEFGIESHMQEHVASMARQYVRGIISSVQRVALALSPSHISSQVGLRTPLGTPEAQTLARWICQSYRGYMGVELLKSNSDGNESILKNLWHHTDAIICCSMKALPVFTFANQAGLDMLETTLVALQDISLEKIFDDNGRKTLCSEFPQIMQQGFACLQGGICLSSMGRPVSYERAVAWKVLNEEENAHCICFVFINWSFV

SEQ ID NO: 163 - DNA, 1962 bp, Arabidopsis thaliana
atggatgatacaatggacatgagttcaggtagtgatgaagaagtacaagaagagaagaccactgttaacgagagggtcatctatcaggctgcattacaagatctgaagcaacccaagaccgaaaaggatctacctcctggtgttcttacagttcctcttatgaggcatcagaaaattgcattgaactggatgcgtaagaaagaaaaaagaagcaggcactgtttgggagggatattagcagatgatcagggacttggtaaaacgatctcgacgatctctcttatcctgttacaaaagttgaagtcacaatcaaagcagagaaagcgaaaaggtcaaaactctggtggtacattgattgtttgtccagcaagtgttgtaaaacaatgggcaagagaagttaaagagaaggtttctgatgaacacaaactctctgttttagtccaccatggatctcacagaaccaaagatccaacagaaatagcaatatatgatgtggtcatgacaacttacgccattgttacaaatgaagttccacaaaaccctatgctgaatcgttatgatagtatgagaggcagagaaagccttgacggatcgagtttgattcagcctcacgttggtgcactaggaagagttaggtggttgagagtagtattagatgaagctcatacaattaaaaaccatagaaccctaattgcaaaagcttgttttagccttagagccaaaaggagatggtgtttgactggaacgccgataaagaacaaagtagacgatctttatagctatttcagatttcttagatatcatccatatgccatgtgcaattcatttcaccaaagaatcaaagctccaattgataaaaagcctcttcatggttacaagaagcttcaagctattctaaggggtataatgttgcgccgcaccaaagaatggtctttctacaggaagcttgaattgaattcacgttggaagtttgaggaatatgctgctgatgggactttgcatgaacacatggcttatcttttggtgatgcttttgcgactacgccaagcttgtaaccatccacaacttgttaacggatatagtcactcagatactacaagaaaaatgtcagatggagttcgagtagcccctagagagaatctaatcatgttcctcgatctcttgaaattatcctcaaccacctgctctgtttgtagtgatccaccaaaagaccctgttgttactttgtgtggccatgtgttttgttatgagtgtgtgtctgtaaacattaacggggataacaatacgtgccctgcacttaattgccacagccagcttaaacatgatgttgttttcactgaatctgcagttagaagttgcatcaacgattatgatgatcctgaagataaaaatgctttagttgcatcaaggcgagtttatttcatcgaaaatccgagctgtgatagagattcttcagtcgcttgcagagcaaggcagtccagacactccaccaataaagacaatagtatcagtggactgaatctcatttttacgtttctcaaagacaaatgtaatgattatgaaacaggtgcgatgttgatgtctcttaaagctggaaaccttggattgaatatggtagctgcaagtcatgtcattctactggacctatggtggaatccaacaacagaggatcaagctattgatcgagctcatcgtatcggacaaactcgagctgttacggtcactcgtattgccatcaaaaataccgttgaggaacgaattttgactcttcatgaacgtaaaaggaacattgttgcatctgcattgggtgaaaaaaactggcaaaagttctgcgattcaactaacactagaagatctcgaatatctgttttttggtgtgtagaatatcccagagtttttattgataagaggaataaaacctttagctatttaataagtcacaagtgtgaatgtaatgaataa

SEQ ID NO: 164 - protein, 653 aa, Arabidopsis thaliana
MDDTMDMSSGSDEEVQEEKTTVNERVIYQAALQDLKQPKTEKDLPPGVLTVPLMRHQKIALNWMRKKEKRSRHCLGGILADDQGLGKTISTISLILLQKLKSQSKQRKRKGQNSGGTLIVCPASVVKQWAREVKEKVSDEHKLSVLVHHGSHRTKDPTEIAIYDVVMTTYAIVTNEVPQNPMLNRYDSMRGRESLDGSSLIQPHVGALGRVRWLRVVLDEAHTIKNHRTLIAKACFSLRAKRRWCLTGTPIKNKVDDLYSYFRFLRYHPYAMCNSFHQRIKAPIDKKPLHGYKKLQAILRGIMLRRTKEWSFYRKLELNSRWKFEEYAADGTLHEHMAYLLVMLLRLRQACNHPQLVNGYSHSDTTRKMSDGVRVAPRENLIMFLDLLKLSSTTCSVCSDPPKDPVVTLCGHVFCYECVSVNINGDNNTCPALNCHSQLKHDVVFTESAVRSCINDYDDPEDKNALVASRRVYFIENPSCDRDSSVACRARQSRHSTNKDNSISGLNLIFTFLKDKCNDYETGAMLMSLKAGNLGLNMVAASHVILLDLWWNPTTEDQAIDRAHRIGQTRAVTVTRIAIKNTVEERILTLHERKRNIVASALGEKNWQKFCDSTNTRRSRISVFWCVEYPRVFIDKRNKTFSYLISHKCECNE

SEQ ID NO: 165 - DNA, 807 bp, Arabidopsis thaliana
atgaatcaagaaggtgcttcacatagcccatcctccacttccaccgaaccagtccgggcacgttggtcacctaaaccggagcaaatcttgatactcgaatccatcttcaacagtggtactgttaacccaccaaaagatgaaacggtgaggataagaaagatgcttgagaaattcggtgctgtgggagacgcaaacgtcttctactggtttcaaaaccgacggtcaagatctcgccggagacaccggcagcttttagcagccaccaccgcagccgccacctccataggagctgaagaccaccagcacatgacggccatgagcatgcatcaatatccttgcagcaacaacgagattgatttggggtttggaagttgtagcaacttatcagctaattacttccttaatggatcgtcgtcatctcaaatcccttcctttttcctcggcctctcttcttcaagtggtgggtgtgagaacaacaatggtatggagaatctcttcaaaatgtatggccatgaatctgatcataatcatcagcagcagcatcatagctcaaatgctgcatcagttttaaacccatctgatcaaaactccaactcccaatacgaacaagaagggtttatgacggtgtttataaacggagttcctatggaagtaacaaaaggagcaatagacatgaaaacaatgttcggtgatgattcggtgttacttcattcctctggtcttcctcttcccactgatgagtttggtttcttgatgcattctttacaacatggacaaacttatttcctggtaccgagacagacatga

SEQ ID NO: 166 - protein, 268 aa, Arabidopsis thaliana
MNQEGASHSPSSTSTEPVRARWSPKPEQILILESIFNSGTVNPPKDETVRIRKMLEKFGAVGDANVFYWFQNRRSRSRRRHRQLLAATTAAATSIGAEDHQHMTAMSMHQYPCSNNEIDLGFGSCSNLSANYFLNGSSSSQIPSFFLGLSSSSGGCENNNGMENLFKMYGHESDHNHQQQHHSSNAASVLNPSDQNSNSQYEQEGFMTVFINGVPMEVTKGAIDMKTMFGDDSVLLHSSGLPLPTDEFGFLMHSLQHGQTYFLVPRQT

SEQ ID NO: 167 - DNA, 1170 bp, Arabidopsis thaliana
atgatcgtgtacggtgggggagcatccgaggacggtgaaggtggaggggtggttctgaagaaagggccatggacggtggccgaggacgagacactggcggcttacgtacgggaatacggtgaagggaactggaattctgttcagaagaagacatggctggctaggtgtggcaagagctgccgcctccgctgggctaaccacttacgacctaatctcaggaaaggctccttcacccccgaggaagaacgtctcatcatacaactccactctcagctaggcaacaaatgggctcgcatggctgctcagttaccaggcagaacagataacgagatcaagaactactggaacacgaggttgaaacgcttccaacgccaaggcctccctctctaccctccagaatattcccaaaacaatcatcaacaacaaatgtatcctcaacagccctcctcacctctcccgtcccaaacacctgcttcttcctttacctttcctctcctccaaccgccttctctgtgtcccaaacgttgttataacactgccttctctcccaaggcctcatatatttcttctccaaccaatttccttgtctcgtctccgacctttcttcacacccattcctctctttcctcctatcagtctaccaatccggtttactccatgaaacatgagctctcttcaaaccaaattccatactctgcctctttaggagtctatcaagtaagcaagttctcagacaatggggattgtaaccaaaacctgaacaccggtttgcatacaaatacctgtcagctgttagaggatcttatggaggaggccgaggctctagctgatagctttcgtgctcctaagcggagacaaatcatggctgcgcttgaggacaacaacaacaacaacaactttttctcgggaggtttcggacatcgtgtttcttccaacagtctatgttccttgcaaggtttaacaccaaaggaagatgagtctctccagatgaacacaatgcaagatgaggacataacaaagcttcttgactggggaagtgaaagtgaagaaatctcaaacgggcaatcctctgtgataacaacagagaacaaccttgtccttgacgatcaccagttcgcttttctgtttccagttgatgatgacaccaacaacttgccagggatctgctag

SEQ ID NO: 168 - protein, 389 aa, Arabidopsis thaliana
MIVYGGGASEDGEGGGVVLKKGPWTVAEDETLAAYVREYGEGNWNSVQKKTWLARCGKSCRLRWANHLRPNLRKGSFTPEEERLIIQLHSQLGNKWARMAAQLPGRTDNEIKNYWNTRLKRFQRQGLPLYPPEYSQNNHQQQMYPQQPSSPLPSQTPASSFTFPLLQPPSLCPKRCYNTAFSPKASYISSPTNFLVSSPTFLHTHSSLSSYQSTNPVYSMKHELSSNQIPYSASLGVYQVSKFSDNGDCNQNLNTGLHTNTCQLLEDLMEEAEALADSFRAPKRRQIMAALEDNNNNNNFFSGGFGHRVSSNSLCSLQGLTPKEDESLQMNTMQDEDITKLLDWGSESEEISNGQSSVITTENNLVLDDHQFAFLFPVDDDTNNLPGIC

SEQ ID NO: 169 - DNA, 696 bp, Arabidopsis thaliana
aatccatagatctcttattaaataacagtgctgaccaagctcttacaaagcaaaccaatctagaacaccaaagttaatggagagctcaaacaggagcagcaacaaccaatcacaagatgacaagcaagctcgtttccggggagttcgaagaaggccttggggaaagtttgcagcagagattcgagacccgtcgagaaacggtgcccgtctttggctcgggacatttgagaccgctgaggaggcagcaagggcttatgaccgagcagcctttaaccttaggggtcatctcgctatactcaacttccctaatgagtattatccacgtatggacgactactcgcttcgccctccttatgcttcttcttcttcgtcgtcgtcatcgggttcaacttctactaatgtgagtcgacaaaaccaaagagaagttttcgagtttgagtatttggacgataaggttcttgaagaacttcttgattcagaagaaaggaagagataatcacgattagttttgttttgatattttatgtggcactgttgtggctacctacgtgcattatgtgcatgtataggtcgcttgattagtactttataacatgcatgccacgaccataaattgtaagagaagacgtactttgcgttttcatgaaatatgaatgttagatggtttgagtacaaaaaaaaaaaaaaaaaaaaaaa

SEQ ID NO: 170 - protein, 139 aa, Arabidopsis thaliana
MESSNRSSNNQSQDDKQARFRGVRRRPWGKFAAEIRDPSRNGARLWLGTFETAEEAARAYDRAAFNLRGHLAILNFPNEYYPRMDDYSLRPPYASSSSSSSSGSTSTNVSRQNQREVFEFEYLDDKVLEELLDSEERKR

SEQ ID NO: 171 - DNA, 952 bp, Arabidopsis thaliana
aagaagaggacatgaagcacagagattctgcagactgcaggtgaccaatggacactttatcaataaaaacatacctactactctcttacactttcaattttccaatacaaatcccaatctttaatctctctttcttcttcatctctctttctctttctctcttcatggctacaaggattccattcacagaatcacaatgggaagaacttgaaaaccaagctcttgtgttcaagtacttagctgcaaatatgcctgttccacctcatcttctcttcctcatcaaaagaccctttctcttctcttcttcttcttcttcatcttcttcttcaagcttcttctctcccactctttctccacactttgggtggaatgtgtatgagatgggaatgggaagaaagatagatgcagagccaggaagatgtagaagaactgatggcaagaaatggagatgctctaaagaagcttaccctgactctaagtactgtgagagacatatgcatagaggcaagaaccgttcttcctcaagaaagcctcctcctactcaattcactccaaatctctttctcgactcttcttccagaagaagaagaagtggatacatggatgatttcttctccatagaaccttccgggtcaatcaaaagctgctctggctcagcaatggaagataatgatgatggctcatgtagaggcatcaacaacgaggagaagcagccggatcgacattgcttcatccttggtactgacttgaggacacgtgagaggccattgatgttagaggagaagctgaaacaaagagatcatgataatgaagaagagcaaggaagcaagaggttttataggtttcttgatgaatggccttcttctaaatcttctgtttctacttcactcttcatttgatcatcttttgttcttataaccttgtatttcttgttaagatggtaatgcaaatt

SEQ ID NO: 172 - protein, 283 aa, Arabidopsis thaliana
MDTLSIKTYLLLSYTFNFPIQIPIFNLSFFFISLSLSLFMATRIPFTESQWEELENQALVFKYLAANMPVPPHLLFLIKRPFLFSSSSSSSSSSSFFSPTLSPHFGWNVYEMGMGRKIDAEPGRCRRTDGKKWRCSKEAYPDSKYCERHMHRGKNRSSSRKPPPTQFTPNLFLDSSSRRRRSGYMDDFFSIEPSGSIKSCSGSAMEDNDDGSCRGINNEEKQPDRHCFILGTDLRTRERPLMLEEKLKQRDHDNEEEQGSKRFYRFLDEWPSSKSSVSTSLFI

SEQ ID NO: 173 - DNA, 920 bp, Arabidopsis thaliana
aggaaacataagtaatcgttgcttcgatcctttgttacatggatggatcctgaacaggaaatctcaaacgagactttggaaactatattggtaagttcaacaaaaggaagcaataataacaataagaaaatggaagaagaaatgaagaagaaagtatcaagaggagaattaggaggtgaagctcaaaattgtccaagatgtgaatctccaaacacaaagttttgttactacaacaactatagtctctcacaacctcgttacttctgcaaatcttgtcggagatattggactaaaggcggtactcttcgtaacgttcccgtcggtggtggttgccgtcgaaacaaacgatcctcttcctcagctttctccaagaacaacaacaataagtctattaatttccatactgatccacttcagaaccctttaattacgggaatgccaccatcatcttttggttatgatcactccattgatctcaacctcgctttcgctactctccaaaagcatcatttatcctctcaagctactacgccttcttttgggtttggaggtgatctttctatttatggaaactcaacgaatgatgtagggatcttcggagggcaaaacggtacttataacaatagtttgtgttatgggtttatgtccggaaatggtaataataatcaaaatgaaatcaagatggcttctacattggggatgtctttggaaggaaacgagagaaagcaagagaatgtgaacaataacaataataactcagagaatcctagcaaggtgttctgggggtttccatggcagatgaccggagattccgccggagttgtaccggagattgatcccggaagggaaagctggaatgggatggtttcatcttggaataatggtttactcaacactcctttggtctagcagatcattaa

SEQ ID NO: 174 - protein, 288 aa, Arabidopsis thaliana
MDPEQEISNETLETILVSSTKGSNNNNKKMEEEMKKKVSRGELGGEAQNCPRCESPNTKFCYYNNYSLSQPRYFCKSCRRYWTKGGTLRNVPVGGGCRRNKRSSSSAFSKNNNNKSINFHTDPLQNPLITGMPPSSFGYDHSIDLNLAFATLQKHHLSSQATTPSFGFGGDLSIYGNSTNDVGIFGGQNGTYNNSLCYGFMSGNGNNNQNEIKMASTLGMSLEGNERKQENVNNNNNNSENPSKVFWGFPWQMTGDSAGVVPEIDPGRESWNGMVSSWNNGLLNTPLV

SEQ ID NO: 175 - DNA, 1451 bp, Arabidopsis thaliana
aattgagattaaagtaatttatctttcagaaaatggcggttgaagacgatgtatctttgataagaacgacgacgttagtggcaccaacaagacccacgattacagttcctcatagacctccggcgatcgaaacggcggcgtatttctttggcggtggagatgggcttagtctaagcccagggccactttcttttgtctcttctttgtttgttgataacttccctgacgtcttgacgccggataaccaacggacgacgtcgtttactcagcttcttaacggaactatgtcggtgtctcctggtggcggaggacgttcaacggcggggatgttcgccggaggaggtccgatgtttacaatcccttctggtttcagcccttctagtcttctcacctcgcccatgttctttcccccgcagtcgtcagctcataccggctttattcaaccacggcagcagtcacaaccgcaaccacaacgaccagacacgtttcctcaccatatgccaccatcgacatccgtcgccgtccatggtcgtcaatctttagacgtttcacaagtagatcaaagagctcgaaaccattataataatccggggaataacaataataaccggtcgtataacgttgtgaacgttgataaaccggcggatgacggttataactggaggaagtacggacaaaagcctatcaaagggtgtgaatatccaaggagttattacaaatgtacacatgttaactgtccggtgaagaagaaagtcgaacggtcatcggatggacagatcactcagatcatttacaaaggtcaacatgatcacgagaggcctcagaatcgccgtggcggtggaggcagagattccactgaggttggtggtgcagggcaaatgatggaatctagtgatgatagtggttatcgtaaggatcatgatgatgatgatgatgatgatgaagatgatgaagatcttccggcttcaaagataagaagaatagacggtgtgtcgacgactcaccggacggtgaccgagcctaagattatcgttcagacaaaaagtgaagtcgatcttctcgacgatggctataggtggcgtaagtacggacaaaaagttgtcaaaggaaatccccatccaaggagctattataaatgtacaacgccaaattgtacggtccgtaaacatgtagagagagcttccacggatgctaaggctgtgattacaacttacgaaggtaaacacaatcacgatgtccctgccgctagaaacggtaccgcggcagcaaccgcagctgcggtggggccgtctgaccaccatcgtatgagatcaatgtcggggaacaatatgcaacaacatatgagtttcggtaacaataataacacaggccaatctccggttcttttgaggttgaaagaagagaaaatcacaatttgacttttaagaaccaaagatttcgagattgatatt

SEQ ID NO: 176 - protein, 461 aa, Arabidopsis thaliana
MAVEDDVSLIRTTTLVAPTRPTITVPHRPPAIETAAYFFGGGDGLSLSPGPLSFVSSLFVDNFPDVLTPDNQRTTSFTQLLNGTMSVSPGGGGRSTAGMFAGGGPMFTIPSGFSPSSLLTSPMFFPPQSSAHTGFIQPRQQSQPQPQRPDTFPHHMPPSTSVAVHGRQSLDVSQVDQRARNHYNNPGNNNNNRSYNVVNVDKPADDGYNWRKYGQKPIKGCEYPRSYYKCTHVNCPVKKKVERSSDGQITQIIYKGQHDHERPQNRRGGGGRDSTEVGGAGQMMESSDDSGYRKDHDDDDDDDEDDEDLPASKIRRIDGVSTTHRTVTEPKIIVQTKSEVDLLDDGYRWRKYGQKVVKGNPHPRSYYKCTTPNCTVRKHVERASTDAKAVITTYEGKHNHDVPAARNGTAAATAAAVGPSDHHRMRSMSGNNMQQHMSFGNNNNTGQSPVLLRLKEEKITI

SEQ ID NO: 177 - DNA, 1270 bp, Arabidopsis thaliana
ttaagaacaggcttcattctctggacaaacactcaaaaaacaaacaaaaaaaggaacatggaagatcagtttcctaaaatagaaactagcttcatgcacgacaagctcttgtcttctggaatctacgggttcttgagttcttcgacgccgccacaacttctcggtgttccaatatttttggaaggtatgaaatctcctcttcttcctgcttcttcgactccgagctactttgtgtcgcctcatgatcatgagctcacatcttctattcatccatctccggtagcttctgttccttggaactttctagaatcttttcctcagtctcaacatcctgatcatcatccttctaaacctccaaaccttactttgttccttaaagaaccaaagctactagaactttctcaatccgaaagcaacatgagcccttaccataaatacatcccaaactccttttatcaatcagaccaaaacagaaacgaatgggtagagatcaataaaactctaaccaactatccctcgaaaggttttggaaactattggctaagtaccaccaagactcaacccatgaagtcaaaaacaagaaaggttgttcagacgacgaccccaacaaaactgtatagaggagtgagacaaagacactggggcaaatgggtcgcagagattaggcttccaaggaacagaacccgtgtttggctcggcacttttgaaaccgctgagcaagcagcaatggcttacgatacagcagcttatatccttcgtggcgaattcgcacacctcaactttcctgatcttaaacaccagctcaagtccggttctttgcgatgcatgatcgcctcacttttggagtccaagattcaacagatctcatcttcccaagtaagtaactctccttctcctcctcctccaaaagtgggaacaccggagcaaaagaatcatcacatgaagatggagtcaggagaagacgtgatgatgaagaaacagaaaagccataaggaagtgatggaaggagatggtgtacaattgagtaggatgccttctttggatatggatctcatttgggatgctctctcatttcctcattcttcttgacttcaaattaatatttgtcaaacttattttacttacttctacccttttttatatcaaaagtttccaccaaagaaagaaattcatattatgatgccaagattggtttgcatttggggttgaacacattgtaattcttcttacgaccacataatcaagtggttctcctttttttgtctgctaa

SEQ ID NO: 178 - protein, 343 aa, Arabidopsis thaliana
MEDQFPKIETSFMHDKLLSSGIYGFLSSSTPPQLLGVPIFLEGMKSPLLPASSTPSYFVSPHDHELTSSIHPSPVASVPWNFLESFPQSQHPDHHPSKPPNLTLFLKEPKLLELSQSESNMSPYHKYIPNSFYQSDQNRNEWVEINKTLTNYPSKGFGNYWLSTTKTQPMKSKTRKVVQTTTPTKLYRGVRQRHWGKWVAEIRLPRNRTRVWLGTFETAEQAAMAYDTAAYILRGEFAHLNFPDLKHQLKSGSLRCMIASLLESKIQQISSSQVSNSPSPPPPKVGTPEQKNHHMKMESGEDVMMKKQKSHKEVMEGDGVQLSRMPSLDMDLIWDALSFPHSS

SEQ ID NO: 179 - DNA, 1536 bp, Arabidopsis thaliana
ctctctgacttgaactcttctcttctaccgaatcaaaccaaatggaggatcatcaaaaccatccacagtacggtatagaacaaccatcttctcaattctcctctgatctcttcggcttcaacctcgtttcagcgccggaccagcaccatcgtcttcatttcaccgaccatgagataagtttattgccacgtggaatacaagggcttacggtggctggaaacaacagtaacactattacaacgatccagagtggtggctgtgttggtgggtttagtggctttacggacggcggaggaacagggaggtggccgaggcaagagacgttgatgttgttggaggtcagatctcgtcttgatcacaagttcaaagaagctaatcaaaagggtcctctctgggatgaagtttctaggattatgtcggaggaacatggatacactaggagtggcaagaagtgtagagagaagttcgagaatctctacaagtactataaaaaaacaaaagaaggcaaatccggtcggcgacaagatggtaaaaactatagatttttccggcagcttgaagcgatatacggcgaatccaaagactcggtttcttgctataacaacacgcagttcataatgaccaatgctcttcatagtaatttccgcgcttctaacattcataacatcgtccctcatcatcagaatcccttgatgaccaataccaatactcaaagtcaaagccttagcatttctaacaatttcaactcctcctccgatttggatctaacttcttcctctgaaggaaacgaaactactaaaagagaggggatgcattggaaggaaaagatcaaggaattcattggtgttcatatggagaggttgatagagaagcaagatttttggcttgagaagttgatgaagattgtggaagacaaagaacatcaaaggatgctgagagaagaggaatggagaaggattgaagcggaaaggatcgataaggaacgttcgttttggacaaaagagagggagaggattgaagctcgggatgttgcggtgattaatgccttgcagtacttgacgggaagggcattgataaggccggattcttcgtctcctacagagaggattaatgggaatggaagcgataaaatgatggctgataatgaatttgctgatgaaggaaataagggcaagatggataaaaaacaaatgaataagaaaaggaaggagaaatggtcaagccacggagggaatcatccaagaaccaaagagaatatgatgatatacaacaatcaagaaactaagattaatgatttttgtcgagatgatgaccaatgccatcatgaaggttactcaccttcaaactccaagaacgcaggaactccgagctgcagcaatgccatggcagctagtacaaagtgctttccattgcttgaaggagaaggagatcagaacttgtgggagggttatggtttgaagcaaaggaaagaaaataatcatcagtaagctacatttttcattctcaaaatgaagaataagagaacttagaaacgat

SEQ ID NO: 180 - protein, 481 aa, Arabidopsis thaliana
MEDHQNHPQYGIEQPSSQFSSDLFGFNLVSAPDQHHRLHFTDHEISLLPRGIQGLTVAGNNSNTITTIQSGGCVGGFSGFTDGGGTGRWPRQETLMLLEVRSRLDHKFKEANQKGPLWDEVSRIMSEEHGYTRSGKKCREKFENLYKYYKKTKEGKSGRRQDGKNYRFFRQLEAIYGESKDSVSCYNNTQFIMTNALHSNFRASNIHNIVPHHQNPLMTNTNTQSQSLSISNNFNSSSDLDLTSSSEGNETTKREGMHWKEKIKEFIGVHMERLIEKQDFWLEKLMKIVEDKEHQRMLREEEWRRIEAERIDKERSFWTKERERIEARDVAVINALQYLTGRALIRPDSSSPTERINGNGSDKMMADNEFADEGNKGKMDKKQMNKKRKEKWSSHGGNHPRTKENMMIYNNQETKINDFCRDDDQCHHEGYSPSNSKNAGTPSCSNAMAASTKCFPLLEGEGDQNLWEGYGLKQRKENNHQ

SEQ ID NO: 181 - DNA, 506 bp, Arabidopsis thaliana
atacttgtcaacaaaaattttcttaaagaacgcataactgtttttttcatggctggttctgtctataaccttccaagtcaaaaccctaatccacagtctttattccaaatctttgttgatcgagtaccactttcaaacttgcctgccacgtcagacgactctagccggactgcagaagataatgagaggaagcggagaaggaaggtatcgaaccgcgagtcagctcggagatcgcgtatgcggaaacagcgtcacatggaagaactgtggtccatgcttgttcaactcatcaataagaacaaatctctagtcgatgagctaagccaagccagggaatgttacgagaaggttatagaagagaacatgaaacttcgagaggaaaactccaagtcgaggaagatgattggtgagatcgggcttaataggtttcttagcgtagaggccgatcagatctggaccttctaatcgtctcgtaagcttgttggttttttgttgtttatttaaag

SEQ ID NO: 182 - protein, 138 aa, Arabidopsis thaliana
MAGSVYNLPSQNPNPQSLFQIFVDRVPLSNLPATSDDSSRTAEDNERKRRRKVSNRESARRSRMRKQRHMEELWSMLVQLINKNKSLVDELSQARECYEKVIEENMKLREENSKSRKMIGEIGLNRFLSVEADQIWTF

SEQ ID NO: 183 - DNA, 1120 bp, Arabidopsis thaliana
gaacagcaaaaccctagatttcctgttcaagctcaagaccgtacaaaactttggaactcatatataaagatctcgagaatagcattatgaatatcgtctcttggaaagatgcaaacgacgaagttgcaggcggcgctacgacaagacgtgaaagagaagtaaaagaggatcaagaagaaaccgaagtcagagccaccagtggcaaaaccgtaattaaaaagcagcctacatcgatctcttcttcttcttcttcgtggatgaaatccaaggatccgaggattgttagggtttcacgcgcctttggaggcaaagaccgtcacagcaaagtgtgtacgttacgtggactacgtgacagacgcgtgagattatcagtcccaacggctattcagctctacgatcttcaagaacggctcggtgttgaccagcctagcaaagccgttgactggttgcttgatgcagctaaagaggagatcgacgagctacctccgttacctatctcgccggaaaatttcagcatcttcaaccatcatcagtccttcttgaatcttggtcaacggcccggtcaagatccgacccaactcgggtttaaaatcaatggatgtgtacaaaagtctactactactagccgcgaagaaaacgatagagagaaaggagaaaacgatgtcgtttacacaaacaatcatcatgttgggtcttatggaacttatcacaacctggaacatcatcatcatcatcaccaacatttgagtttacaggcagattatcatagtcatcaactacatagtcttgtcccatttccatcacaaattttggtatgtccaatgacgacatcaccaacaactacaactatacaatctttgtttccatcatcatcgtcagctggttcagggactatggagacattagatccgaggcaaatgtagcaacaatggtggtagagacattgataatcggatgtcgtcggtccaattcaaccgaactaatagcactacaacggctaacatgtcgaggcatctaggctcggagcgttgtacaagtagaggaagtgatcaccatatgtgaagttagattattgaaacgatataattgttgtttgatgtgttcagaaataaggggacac

SEQ ID NO: 184 - protein, 278 aa, Arabidopsis thaliana
MNIVSWKDANDEVAGGATTRREREVKEDQEETEVRATSGKTVIKKQPTSISSSSSSWMKSKDPRIVRVSRAFGGKDRHSKVCTLRGLRDRRVRLSVPTAIQLYDLQERLGVDQPSKAVDWLLDAAKEEIDELPPLPISPENFSIFNHHQSFLNLGQRPGQDPTQLGFKINGCVQKSTTTSREENDREKGENDVVYTNNHHVGSYGTYHNLEHHHHHHQHLSLQADYHSHQLHSLVPFPSQILVCPMTTSPTTTTIQSLFPSSSSAGSGTMETLDPRQM

SEQ ID NO: 185 - DNA, 1514 bp, Arabidopsis thaliana
actctcttaactttcgtttcttctcctaccttcttttaccaacctttcctttctcttacacacatatatatatacatatatagagagagagaagaggacaaagagttgaaagatgaagactctcatgtcttcatagaaacaagtgatatgtgcgctaagaaagaagaagaagaagaagaagaagaagacagttctgaagccatgaacaacatacaaaattaccaaaatgacctcttctttcaccaactcatctctcatcatcaccatcatcatcatgatccttctcaatctgaaactttgggagcatccggtaacgttggatctggtttcactatcttctctcaagattccgtctctccaatatggtctctacctccacctacctcgatccaaccaccatttgatcagtttcctcctccttcttcttctccagcatctttctacggaagtttcttcaacagaagtcgagctcatcatcagggattacagtttgggtacgagggttttggtggagccacgtcagcagcacatcatcatcatgaacaacttcggatcttgtcggaagctttaggtccggtagtacaagccgggtccggtccttttgggttacaagctgagttagggaagatgacagcacaagagatcatggacgctaaagctttggctgcttcaaagagtcatagtgaagctgagagaagaagaagagagagaatcaataatcatctcgctaagctccgtagcatattacccaacaccaccaaaacggataaagcgtcgttactagctgaagtgatccaacatgtgaaagagttgaagagagagacttcagtgatctcagagacaaatcttgtcccaacggaaagcgatgagttaacggtagctttcacggaggaggaagaaaccggagatggcagatttgtaattaaagcgtcgctttgctgtgaagacaggtcggatctcttgcctgacatgattaaaacattgaaagctatgcgtctcaaaacgctcaaggcggagataaccaccgttgggggacgagtcaagaacgttttgtttgttaccggagaagagagctccggtgaggaagtggaggaagagtactgtatagggacgattgaggaagctttgaaagcggtgatggagaagagcaatgtagaggaatcatcttcttctggaaatgctaagagacagagaatgagtagtcacaacactatcactatcgtcgaacaacaacaacaatataatcagaggtaatcaattttttacttaaatcgcttttttttcttactttcggtgtatctactacgtgtgttgtttgctggttatggaaatgaatgttgtacgtcacgttatactatagatatatgtgtgtttgtgtgtatgtataacggaagtatttgtatccgttgtggtcttggacttttggtttggttctaagatacttatttttaaaaacttgtatcgttgagttggttttctagatatgcttaatgggagtatgtgacgaaaaaaaa

SEQ ID NO: 186 - protein, 368 aa, Arabidopsis thaliana
MCAKKEEEEEEEEDSSEAMNNIQNYQNDLFFHQLISHHHHHHHDPSQSETLGASGNVGSGFTIFSQDSVSPIWSLPPPTSIQPPFDQFPPPSSSPASFYGSFFNRSRAHHQGLQFGYEGFGGATSAAHHHHEQLRILSEALGPVVQAGSGPFGLQAELGKMTAQEIMDAKALAASKSHSEAERRRRERINNHLAKLRSILPNTTKTDKASLLAEVIQHVKELKRETSVISETNLVPTESDELTVAFTEEEETGDGRFVIKASLCCEDRSDLLPDMIKTLKAMRLKTLKAEITTVGGRVKNVLFVTGEESSGEEVEEEYCIGTIEEALKAVMEKSNVEESSSSGNAKRQRMSSHNTITIVEQQQQYNQR

SEQ ID NO: 187 - DNA, 1456 bp, Arabidopsis thaliana
attagggttttgttgtcgtgagatttgattacacaaattgctgaatttggtttcgattattggtgttattgttttcgaagatttccagtgagtttccgtttatggatctgactggaggatttggagctagatccggcggtgttggaccgtgccgggaaccaataggccttgaatcgctacatctcggtgacgaatttcggcaactagtgacgactttacctcccgagaaccccggcggttcgttcacggctttgcttgagcttccacctacacaagcagtggagcttctccatttcactgattcttcgtcttctcaacaagcggcagtgacagggatcggtggagagattcctccgccgcttcactctttcggtgggacattggcttttccttctaactcagttctcatggagcgagcagctcgtttctcggtgattgccactgagcaacaaaacggaaatatctccggggagactccgacgagctctgtaccttccaattcaagtgctaatctcgacagagtcaagacggagcctgctgagaccgattcatctcagcggttgatttctgattcagcgattgagaatcaaatcccttgccctaaccagaacaatcgaaatgggaagaggaaagatttcgaaaagaagggtaaaagctcgacgaagaagaacaaaagctctgaagagaacgagaagctgccatatgttcacgttagagctcgtcgtggtcaagcaaccgatagccatagcttagcagaacgagcaagaagagagaagataaatgcacgaatgaagctgttacaggaactggtcccaggctgtgataagattcaaggtaccgcgctggtgctggatgaaatcattaaccatgtccagtcattacaacgtcaagtggagatgctatcaatgagacttgctgcggtaaaccccagaatcgacttcaatctcgacaccatattggcttcagaaaacggttctttaatggatgggagcttcaatgccgcaccaatgcagcttgcttggcctcagcaagccattgagaccgaacagtcctttcatcaccggcaactgcaacaaccaccaacacaacaatggccttttgacggcttgaaccagccggtatggggaagagaagaggatcaagctcatggcaatgataacagcaatttgatggcagtttctgaaaatgtaatggtggcttctgctaatttgcacccaaatcaggtcaaaatggagctgtaagttgggaaaacggtagagatcatgaatgtgtatatacatcgtataagctcgtttctctctatataaatataatcataaatatagatatctgttaagaaggtatcagtcatttgattcagagagacaacactggtatgattgtttcttattcttgtaccagatttcgacaatgtagaatttagtaggatatgatcattttgatctcgttatatata

SEQ ID NO: 188 - protein, 379 aa, Arabidopsis thaliana
MDLTGGFGARSGGVGPCREPIGLESLHLGDEFRQLVTTLPPENPGGSFTALLELPPTQAVELLHFTDSSSSQQAAVTGIGGEIPPPLHSFGGTLAFPSNSVLMERAARFSVIATEQQNGNISGETPTSSVPSNSSANLDRVKTEPAETDSSQRLISDSAIENQIPCPNQNNRNGKRKDFEKKGKSSTKKNKSSEENEKLPYVHVRARRGQATDSHSLAERARREKINARMKLLQELVPGCDKIQGTALVLDEIINHVQSLQRQVEMLSMRLAAVNPRIDFNLDTILASENGSLMDGSFNAAPMQLAWPQQAIETEQSFHHRQLQQPPTQQWPFDGLNQPVWGREEDQAHGNDNSNLMAVSENVMVASANLHPNQVKMEL

SEQ ID NO: 189 - DNA, 1106 bp, Arabidopsis thaliana
ccctttcgtttttatttaaatttcttgggtcgtttcttaaatttgtatgtgtttattaatggagatcaacaataatgccaacaatactaatactactattgataatcacaaggcaaagatgagccttgtgttgtcaacggatgctaagccaaggttgaaatggacttgtgatcttcatcacaaattcatcgaagccgttaatcaacttggaggacctaacaaagcaacacctaagggtttgatgaaggttatggagattcctgggcttaccttataccatctcaagagccatttacagaaatatcggttagggaagagcatgaagttcgatgataacaagctagaagtttcctctgcatcagagaatcaagaagttgagagtaaaaacgattcaagagatctccgaggctgcagtgtcaccgaagaaaacagcaatccagctaaagaagggctacaaatcacagaggctttacaaatgcagatggaagttcagaagaaacttcatgaacaaatcgaagttcagaggcatttgcaggtgaagattgaggcacaaggaaagtatctacagtccgttttaatgaaagctcaacaaactctcgctggctactcatcttcaaatctcggcatggattttgcgaggaccgagctctctagattagcttcaatggtgaacagaggctgtccaagcacttcgttctcagagctaacgcaagtagaagaagaagaagaaggtttcttgtggtacaagaaaccagaaaacagaggaattagtcagctgagatgttcagtagagagctcgttgacatcttcagagacctcagagacaaaactggatactgacaataaccttaataaatcgattgaacttccgttgatggagatcaactcggaagtgatgaaggggaagaagagaagcataaacgacgtcgtttgcgtggagcagcctctaatgaagagagcttttggagttgatgatgatgagcatttgaagttgagtttgaatacttacaagaaagacatggaggcgtgtacgaacataggactagggtttaattaaaaaaaaaacattttactaaagttatataaaaatgttttaaaagaatcca

SEQ ID NO: 190 - protein, 336 aa, Arabidopsis thaliana
MCLLMEINNNANNTNTTIDNHKAKMSLVLSTDAKPRLKWTCDLHHKFIEAVNQLGGPNKATPKGLMKVMEIPGLTLYHLKSHLQKYRLGKSMKFDDNKLEVSSASENQEVESKNDSRDLRGCSVTEENSNPAKEGLQITEALQMQMEVQKKLHEQIEVQRHLQVKIEAQGKYLQSVLMKAQQTLAGYSSSNLGMDFARTELSRLASMVNRGCPSTSFSELTQVEEEEEGFLWYKKPENRGISQLRCSVESSLTSSETSETKLDTDNNLNKSIELPLMEINSEVMKGKKRSINDVVCVEQPLMKRAFGVDDDEHLKLSLNTYKKDMEACTNIGLGFN

SEQ ID NO: 191 - DNA, 1223 bp, Arabidopsis thaliana
caatattctttctccattgagattaagcttctttctcgctgtcgtctctctatagatcttggttcttagtcccttttgaataataatgatggtggagatggattacgctaagaaaatgcagaaatgtcatgaatacgttgaagcacttgaagaagaacagaagaaaatccaagtctttcaacgcgagcttcctttatgtttagagcttgtcactcaagcgatcgaagcttgtcggaaggagttatctggtacgacgacaactacatcagaacagtgttcagaacagaccacaagtgtttgtggtggtcctgtctttgaagagtttattcctatcaagaaaattagttccttgtgtgaagaagtacaagaagaagaagaagaagatggtgaacatgaatcttctccagaacttgtgaataataagaaatcagattggcttagatctgttcagctatggaatcattcaccggatctaaatccaaaagaggagcgtgtagctaagaaagcgaaagtggtggaggtgaaaccaaaaagcggtgcgtttcagccgtttcaaaagcgcgttttggagactgatttgcaaccggcggtgaaagtagctagttcgatgccagcgacgacgacgagttctacgacggaaacttgtggtggtaaaagtgatttgattaaagctggagatgaggaaagacggatagagcagcagcaatcgcagtcgcatacgcatagaaaacaaaggcggtgctggtcgccggaattacaccgtcgattcctaaacgcgcttcagcagcttggaggatctcatgttgctacaccaaagcaaatcagggatcacatgaaggttgatggattaacaaacgacgaagttaaaagccatttacagaaatatagacttcacacaagaaggccagcagcaacatccgtggcggcacaaagtaccgggaatcagcaacaaccacaatttgtggtggttggaggcatatgggtaccatcgtcacaagattttccaccaccgtccgatgtagccaacaagggtggtgtatatgctccggttgcggtggcgcaatctccaaaacgttcgttggagagaagttgcaactcgccggcggcatcttcctctacaaatacaaatacttctactcctgtgtcataatctgatagtcatactataatcatctcctgatgttgattttggtgtaggtttgaaaatgtttatgtgaatgtaa

SEQ ID NO: 192 - protein, 354 aa, Arabidopsis thaliana
MMVEMDYAKKMQKCHEYVEALEEEQKKIQVFQRELPLCLELVTQAIEACRKELSGTTTTTSEQCSEQTTSVCGGPVFEEFIPIKKISSLCEEVQEEEEEDGEHESSPELVNNKKSDWLRSVQLWNHSPDLNPKEERVAKKAKVVEVKPKSGAFQPFQKRVLETDLQPAVKVASSMPATTTSSTTETCGGKSDLIKAGDEERRIEQQQSQSHTHRKQRRCWSPELHRRFLNALQQLGGSHVATPKQIRDHMKVDGLTNDEVKSHLQKYRLHTRRPAATSVAAQSTGNQQQPQFVVVGGIWVPSSQDFPPPSDVANKGGVYAPVAVAQSPKRSLERSCNSPAASSSTNTNTSTPVS

SEQ ID NO: 193 - DNA, 653 bp, Arabidopsis thaliana
caaatcagaaaatatagagtttgaaggaaactaaaagatggtacattcgaggaagttccgaggtgtccgccagcgacaatggggttcttgggtctctgagattcgccatcctctattgaagagaagagtgtggcttggaactttcgaaacggcagaagcggctgcaagagcatacgaccaagcggctcttctaatgaacggccaaaacgctaagaccaatttccctgtcgtaaaatcagaggaaggctccgatcacgttaaagatgttaactctccgttgatgtcaccaaagtcattatctgagcttttgaacgctaagctaaggaagagctgcaaagacctaacgccttctttgacgtgtctccgtcttgatactgacagttcccacattggagtttggcagaaacgggccgggtcgaaaacaagtccgacttgggtcatgcgcctcgaacttgggaacgtagtcaacgaaagtgcggttgacttagggttgactacgatgaacaaacaaaacgttgagaaagaagaagaagaagaagaagctattattagtgatgaggatcagttagctatggagatgatcgaggagttgctgaattggagttgacttttgactttaacttgttgcaagtccacaaggggtaagggttttc

SEQ ID NO: 194 - protein, 189 aa, Arabidopsis thaliana
MVHSRKFRGVRQRQWGSWVSEIRHPLLKRRVWLGTFETAEAAARAYDQAALLMNGQNAKTNFPVVKSEEGSDHVKDVNSPLMSPKSLSELLNAKLRKSCKDLTPSLTCLRLDTDSSHIGVWQKRAGSKTSPTWVMRLELGNVVNESAVDLGLTTMNKQNVEKEEEEEEAIISDEDQLAMEMIEELLNWS

SEQ ID NO: 195 - DNA, 651 bp, Arabidopsis thaliana
atggaaatagaaataaggagaggtccatggactgtggaagaagacatgaagctcgtcagttacatttctcttcacggtgaaggaagatggaactccctctctcgttctgctggactgaatagaacggggaaaagttgcagattgcggtggctaaattatctccggccggatatccgccgtggagacatatcccttcaagaacaatttatcatccttgaactccattctcgttggggaaatcggtggtcaaagattgctcaacatttaccgggaagaacagataacgagataaagaattattggagaacacgtgttcaaaagcatgcaaaacttctaaaatgtgacgtgaacagcaagcaattcaaagacaccatcaaacatctctggatgcctcgtctcatcgagagaatcgccgccactcaaagtgtccaatttacctctaaccactactcgcctgagaactccagcgtcgccaccgccacgtcatcaacgtcgtcgtctgaggctgtgagatcgagtttctacggtggtgatcaggtggaatttggaacgttggatcatatgacaaatggtggttattggttcaacggcggagatacgtttgaaactttgtgtagttttgacgagctcaacaagtggctcatacagtag

SEQ ID NO: 196 - protein, 216 aa, Arabidopsis thaliana
MEIEIRRGPWTVEEDMKLVSYISLHGEGRWNSLSRSAGLNRTGKSCRLRWLNYLRPDIRRGDISLQEQFIILELHSRWGNRWSKIAQHLPGRTDNEIKNYWRTRVQKHAKLLKCDVNSKQFKDTIKHLWMPRLIERIAATQSVQFTSNHYSPENSSVATATSSTSSSEAVRSSFYGGDQVEFGTLDHMTNGGYWFNGGDTFETLCSFDELNKWLIQ

SEQ ID NO: 197 - DNA, 396 bp, Arabidopsis thaliana
atgggtctctcgcattttccaacagcgtcagaaggagtactaccacttctggtgatgaacacggttgtttcaatcactctgttgaagaacatggtgaggtctgtttttcaaattgttgcatccgagactgaatcttccatggagatagacgacgagcctgaagatgattttgttactagaagaatctcgataacacagttcaagtctctatgtgagaacatagaagaggaagaagaagagaaaggtgtggagtgttgtgtgtgcctttgtgggtttaaagaggaagaggaagtgagtgagttggtttcttgcaagcatttcttccacagagcttgtctagacaactggtttggtaataaccacaccacatgccctctttgcaggtccattctctag

SEQ ID NO: 198 - protein, 131 aa, Arabidopsis thaliana
MGLSHFPTASEGVLPLLVMNTVVSITLLKNMVRSVFQIVASETESSMEIDDEPEDDFVTRRISITQFKSLCENIEEEEEEKGVECCVCLCGFKEEEEVSELVSCKHFFHRACLDNWFGNNHTTCPLCRSIL

SEQ ID NO: 199 - DNA, 1379 bp, Arabidopsis thaliana
ttacttttgtgtttcttcatattcttcagaagcaagcacaaggctagggatcgaagaagcggcgatcactgatcgtatctcactacgatcacattaatggatagaatgtgtggtttccgctcgacggaagactattcggagaaagcgacgttgatgatgccgtccgattatcagtctttgatttgttcaaccaccggagacaatcaaagactgtttggatccgacgaactcgctaccgctttgtcctcggagttgcttccgcgtattcgaaaagctgaggataatttctctcttagtgtcatcaaatccaaaatcgcttctcatcctttgtatcctcgcttactccaaacctacatcgattgccaaaaggtgggagcgcctatggaaatagcgtgtatattggaagagattcagcgagagaaccatgtgtacaagagagatgttgctccattatcttgctttggagctgatcctgagcttgatgaattcatggaaacctactgtgatatattggttaaatacaaaaccgatcttgcgaggccgttcgacgaggctacaactttcataaacaagattgaaatgcagcttcagaacttgtgcactggtccagcgtctgctacagctctttcagatgatggtgcggtttcatctgacgaggaactgagagaagatgatgacatagcagcggatgacagccaacaaagaagcaatgaccgcgatctgaaggaccagctactacgcaaatttggtagccatatcagttcattgaaactcgagttctctaaaaagaagaagaaagggaagctaccaagagaagcaagacaagcgttgctcgattggtggaatgttcataataaatggccttaccctactgaaggcgacaaaatagctctggctgaagaaacaggtttggatcaaaaacaaatcaacaattggtttataaaccaaaggaaacgccattggaagccttcggagaacatgccgtttgatatgatggacgattctaatgaaacattctttaccgaggaatgaaaagagagacatgggattgtgcattgtataatttttacactgttttcccaagaaaagaaaacagtaaaaagcttttggtaaatgggacatcatcgcgaatgaatggaaccagttagccaaaacggtcaagggcgtggcgtaacgagacattgtattggaaatagtggcaatattatgtcactaatcttccaatggtccaaaatgatagatttcttatttgtattgaaccttacttagatagctgatgtgtcaactaaataatttattttcatccttatactacttgtatcaatgtctctaattgatcaattgttgcttgctattcaaaaaaaaaaaaaaaaaaaaaa

SEQ ID NO: 200 - protein, 311 aa, Arabidopsis thaliana
MDRMCGFRSTEDYSEKATLMMPSDYQSLICSTTGDNQRLFGSDELATALSSELLPRIRKAEDNFSLSVIKSKIASHPLYPRLLQTYIDCQKVGAPMEIACILEEIQRENHVYKRDVAPLSCFGADPELDEFMETYCDILVKYKTDLARPFDEATTFINKIEMQLQNLCTGPASATALSDDGAVSSDEELREDDDIAADDSQQRSNDRDLKDQLLRKFGSHISSLKLEFSKKKKKGKLPREARQALLDWWNVHNKWPYPTEGDKIALAEETGLDQKQINNWFINQRKRHWKPSENMPFDMMDDSNETFFTEE

SEQ ID NO: 201 - DNA, 3829 bp, Arabidopsis thaliana
ctttttaagagcttaaaaatttgctttgaagcttcaaatattcttatgaactaaaaagaagaaaaaagcttttgtttctttttccttagcagcagaatgatttttgtttccaaaattattactatttagtttctctcgtgctcttctcttgagcaaatacagattcgttaattttgctgaagaagaagaactctgtttcttccctgcaccaaaccaattttttcgttctttctataaaccatgaaagctccatcaaatggatttcttccaagttccaacgaaggagagaagaagccaatcaattctcaactatggcacgcttgtgcagggcctttagtttcattacctcctgtgggaagtcttgtggtttacttccctcaaggacacagcgagcaagttgcagcatcgatgcagaagcaaacagattttataccaaattacccaaatcttccttctaagctgatttgcttgcttcacagtgttacattacatgctgataccgaaacagatgaagtctatgcacaaatgactcttcaacctgtgaataagtatgatagagaagcattgctagcttctgatatgggcttgaagctaaacagacaacctactgagtttttttgcaagactcttactgcaagtgacacaagcactcatggtggattctctgtaccgcgtcgtgcagctgagaaaatattccctcctcttgatttctcgatgcaaccgcctgcgcaagagattgtagctaaagatttacatgatactacatggactttcagacatatctatcgaggccaaccaaaaagacacttgcttaccacaggttggagcgtttttgttagcacaaagagactatttgcgggtgattcagttttgtttgtaagagatgagaaatcacagctgatgttgggtataagacgtgcaaatagacaaactccgactctttcctcatcggtcatatccagcgacagtatgcacattgggatacttgcagctgcagctcatgctaatgccaatagtagcccttttaccatcttcttcaatccaagggcaagtccttcagagtttgtagttcctttagccaaatacaacaaagccttatacgctcaagtatctctaggaatgagattccggatgatgtttgagactgaggattgtggggttcgtagatatatgggtacagtcacaggtattagtgatcttgaccctgtaagatggaaaggctcacaatggcgtaatcttcaggtaggatgggatgaatcaacagctggagataggccaagccgagtatccatatgggaaatcgaacccgtcataactcctttttacatatgtcctcctccatttttcagacctaagtacccgaggcaacccgggatgccagatgatgagttagacatggaaaatgctttcaaaagagcaatgccttggatgggagaagactttgggatgaaggacgcacagagttcgatgttccctggtttaagtctagttcaatggatgagtatgcagcaaaacaatccattgtcaggttctgctactcctcagctcccgtccgcgctctcatcttttaacctaccaaacaattttgcttccaacgacccttccaagctgttgaacttccaatccccaaacctctcttccgcaaattcccaattcaacaaaccgaacacggttaaccatatcagccaacagatgcaagcacaaccagccatggtgaaatctcaacaacaacaacaacaacaacaacaacaacaccaacaccaacaacaacaactgcaacaacaacaacaactacagatgtcacagcaacaggtgcagcaacaagggatttataacaatggtacgattgctgttgctaaccaagtctcttgtcaaagtccaaaccaacctactggattctctcagtctcagcttcagcagcagtcaatgctccctactggtgctaaaatgacacaccagaacataaattctatggggaataaaggcttgtctcaaatgacatcgtttgcgcaagaaatgcagtttcagcagcaactggaaatgcataacagtagccagttattaagaaaccagcaagaacagtcctctctccattcattacaacaaaatctgtcccaaaatcctcagcaactccaaatgcaacaacaatcatcaaaaccaagtccttcacaacagcttcagttgcagctactgcagaagctacagcagcagcaacagcagcagtcgattcctccagtaagctcatccttacagccacaattatcagcgttgcagcagacacaaagccatcaattgcaacaacttctgtcgtctcaaaatcaacagcccttggcacatggtaataacagcttcccagcttcaactttcatgcagcctccacagattcaggtgagtcctcagcagcaaggacagatgagtaacaaaaatcttgtagccgctggaagatcacattctggccacacagatggagaagctccttcttgttcaacctcaccttccgccaataacacgggacatgataatgtttcaccgacaaatttcctgagcagaaatcaacagcaaggacaagctgcatctgtatctgcatctgattcagtctttgagcgcgcaagcaatccggtccaagagctttatacaaaaactgagagccggatcagtcaaggcatgatgaatatgaagagtgctggtgaacatttcagatttaaaagcgcggtaacagatcaaatcgatgtatccacagcgggaacgacgtactgtcctgatgttgttggccctgtacagcagcaacaaactttcccactaccatcatttggttttgatggagactgccaatctcatcatccaagaaacaacttagctttccctggtaatctcgaagccgtaacttctgatccactctattctcaaaaggactttcaaaacttggttcccaactatggcaacacaccaagagacattgagacggagctgtccagtgctgcaatcagttctcagtcatttggtattcccagcattccctttaagcccggatgttcaaatgaggttggcggcatcaatgattcaggaatcatgaatggtggaggactgtggcccaatcagactcaacgaatgcgaacatatacaaaggttcaaaaacgagggtcagtaggtagatcaatagatgttacccgttatagcggctatgatgaacttaggcatgacttagcgagaatgtttggcatcgaaggacagctcgaagatccgctaacctctgattggaaactcgtctacaccgatcacgaaaacgatattttactagttggtgatgatccttgggaagagtttgtgaactgcgtgcagaacataaagatactatcatcagtagaagttcagcaaatgagcttagacggagatcttgcagctatcccaaccacaaaccaagcctgcagcgaaacagacagcggaaatgcttggaaagtacactatgaagacacttctgctgcagcttctttcaacagatagaaataaaaagatgcaaatataccaagtcaacttacattatcattcgaggccatcgcaaagtacatgtttttttttgtgtgtatgtactgcaaacaacaaactgagaagaagaagatactgcacggtatataaacatttttataggacagtgatttgatttttcattctaacttgatgttgttgtactttcttgtttccatatttgtataacaagtataatgcttgacaagtctatgaggagcatatcttatacagagatactaagatgtaatgttaatgtaactaaacaattaccttcattaatcatgaatcctttggtcgtttaaaa

SEQ ID NO: 202 - protein, 1086 aa, Arabidopsis thaliana
MKAPSNGFLPSSNEGEKKPINSQLWHACAGPLVSLPPVGSLVVYFPQGHSEQVAASMQKQTDFIPNYPNLPSKLICLLHSVTLHADTETDEVYAQMTLQPVNKYDREALLASDMGLKLNRQPTEFFCKTLTASDTSTHGGFSVPRRAAEKIFPPLDFSMQPPAQEIVAKDLHDTTWTFRHIYRGQPKRHLLTTGWSVFVSTKRLFAGDSVLFVRDEKSQLMLGIRRANRQTPTLSSSVISSDSMHIGILAAAAHANANSSPFTIFFNPRASPSEFVVPLAKYNKALYAQVSLGMRFRMMFETEDCGVRRYMGTVTGISDLDPVRWKGSQWRNLQVGWDESTAGDRPSRVSIWEIEPVITPFYICPPPFFRPKYPRQPGMPDDELDMENAFKRAMPWMGEDFGMKDAQSSMFPGLSLVQWMSMQQNNPLSGSATPQLPSALSSFNLPNNFASNDPSKLLNFQSPNLSSANSQFNKPNTVNHISQQMQAQPAMVKSQQQQQQQQQQHQHQQQQLQQQQQLQMSQQQVQQQGIYNNGTIAVANQVSCQSPNQPTGFSQSQLQQQSMLPTGAKMTHQNINSMGNKGLSQMTSFAQEMQFQQQLEMHNSSQLLRNQQEQSSLHSLQQNLSQNPQQLQMQQQSSKPSPSQQLQLQLLQKLQQQQQQQSIPPVSSSLQPQLSALQQTQSHQLQQLLSSQNQQPLAHGNNSFPASTFMQPPQIQVSPQQQGQMSNKNLVAAGRSHSGHTDGEAPSCSTSPSANNTGHDNVSPTNFLSRNQQQGQAASVSASDSVFERASNPVQELYTKTESRISQGMMNMKSAGEHFRFKSAVTDQIDVSTAGTTYCPDVVGPVQQQQTFPLPSFGFDGDCQSHHPRNNLAFPGNLEAVTSDPLYSQKDFQNLVPNYGNTPRDIETELSSAAISSQSFGIPSIPFKPGCSNEVGGINDSGIMNGGGLWPNQTQRMRTYTKVQKRGSVGRSIDVTRYSGYDELRHDLARMFGIEGQLEDPLTSDWKLVYTDHENDILLVGDDPWEEFVNCVQNIKILSSVEVQQMSLDGDLAAIPTTNQACSETDSGNAWKVHYEDTSAAASFNR

SEQ ID NO: 203 - DNA, 992 bp, Arabidopsis thaliana
ctctgctggtatcattggagtctagggttttgttattgacatgcgtggtgtgtcagaattggaggtggggaagagtaatcttccggcggagagtgagctggaattgggattagggctcagcctcggtggtggcgcgtggaaagagcgtgggaggattcttactgctaaggattttccttccgttgggtctaaacgctctgctgaatcttcctctcaccaaggagcttctcctcctcgttcaagtcaagtggtaggatggccaccaattgggttacacaggatgaacagtttggttaataaccaagctatgaaggcagcaagagcggaagaaggagacggggagaagaaagttgtgaagaatgatgagctcaaagatgtgtcaatgaaggtgaatccgaaagttcagggcttagggtttgttaaggtgaatatggatggagttggtataggcagaaaagtggatatgagagctcattcgtcttacgaaaacttggctcagacgcttgaggaaatgttctttggaatgacaggtactacttgtcgagaaaaggttaaacctttaaggcttttagatggatcatcagactttgtactcacttatgaagataaggaaggggattggatgcttgttggagatgttccatggagaatgtttatcaactcggtgaaaaggcttcggatcatgggaacctcagaagctagtggactagctccaagacgtcaagagcagaaggatagacaaagaaacaaccctgtttagcttcccttccaaagctggcattgtttatgtattgtttgaggtttgcaatttactcgatactttttgaagaaagtattttggagaatatggataaaagcatgcagaagcttagatatgatttgaatccggttttcggatatggttttgcttaggtcattcaattcgtagttttccagtttgtttcttctttggctgtgtaccaattatctatgttctgtgagagaaagctctt

SEQ ID NO: 204 - protein, 239 aa, Arabidopsis thaliana
MRGVSELEVGKSNLPAESELELGLGLSLGGGAWKERGRILTAKDFPSVGSKRSAESSSHQGASPPRSSQVVGWPPIGLHRMNSLVNNQAMKAARAEEGDGEKKVVKNDELKDVSMKVNPKVQGLGFVKVNMDGVGIGRKVDMRAHSSYENLAQTLEEMFFGMTGTTCREKVKPLRLLDGSSDFVLTYEDKEGDWMLVGDVPWRMFINSVKRLRIMGTSEASGLAPRRQEQKDRQRNNPV

SEQ ID NO: 205 - DNA, 842 bp, Arabidopsis thaliana
cagagatctgacggcggtagcagagtaatctattccttcccaaaatgtctcgcaattagattctttccaagttcttctgtaaatcccaagtcccgctcttttcctctttatccttttcaccagcttcgctactaagacaacaaatctttccctctctctctcgcctgatcgatcttcaaagagtaagaaaaatgcaggaacaagcgactagctctttagctgcaagctctttaccatcaagcagcgagaggtcatcaagctctgctccacatttggagatcaaagaaggaattgaaagcgatgaggagatacggcgagtgccggagtttggaggagaagctgtcggaaaagaaacttccggtagagaatctggatcggcgaccggtcaggagcggacacaggcgactgtcggagaaagtcaaaggaagcgagggaggacaccggcggagaaagagaacaagcggctgaagaggttgttgaggaacagagtttcagctcagcaagcaagagagaggaaaaaggcttacttgagcgagttggaaaacagagtgaaagacttggagaacaaaaactctgaacttgaagagcgactctctactcttcagaacgagaaccagatgcttagacatattctgaagaacacaacaggaaacaagagaggaggtggtggtggttctaatgctgatgcaagcctttgatctccttcttcttcttgtgttatatttttgtggataaaatttacagagaattgtatcaataattatcatgttaaaattatatgggatgtgagagctaatattgcaattgtagaccaagttctcttaaaaaaaaaaaaaaaaaaa

SEQ ID NO: 206 - protein, 168 aa, Arabidopsis thaliana
MQEQATSSLAASSLPSSSERSSSSAPHLEIKEGIESDEEIRRVPEFGGEAVGKETSGRESGSATGQERTQATVGESQRKRGRTPAEKENKRLKRLLRNRVSAQQARERKKAYLSELENRVKDLENKNSELEERLSTLQNENQMLRHILKNTTGNKRGGGGGSNADASL

SEQ ID NO: 207 - DNA, 2290 bp, Arabidopsis thaliana
aaaaacagactgagagagagagagagagagtgtgttgttggccatgggatgcacggcctccaagctcgacagtgaggatgctgtccgtcgctgcaaggagcggcgccgtcttatgaaggacgccgtctacgctcgtcaccatctcgccgccgctcactctgactactgccgctcccttcgtctcactggctctgccctctcctccttcgccgccggcgagcccctctccgtctccgagaatactcccgctgtttttctccgcccttcctccagtcaggacgcgccacgtgtcccttcttcccattccccagaaccccctcctccgcccatccgcagcaagcctaagcctactaggcctaggaggcttccacacattctctccgactcctctccttcttcctctcctgccaccagtttctatcccactgctcaccagaactctacttactctcgctctccatctcaagcttcctctgtctggaactgggagaatttctaccctccctctccccccgactccgagtacttcgaacgcaaagctcgccagaaccacaagcaccgtcctccttccgactacgacgccgaaactgaaagatccgaccacgattactgccactcacggagagatgccgccgaggaagttcactgcagcgagtggggcgacgaccacgaccgtttcactgccacctcttcgtccgacggagatggggaggtcgaaactcacgtttccagatccggtattgaagaagagcctgtgaaacaaccacatcaagacccaaatggcaaagagcactctgaccatgttaccacttcttccgactgctacaagaccaaattggtggtaaggcacaagaatttgaaggagatccttgacgccgttcaagactacttcgacaaggctgcctccgctggggaccaggtctccgccatgcttgagatcggccgggctgagctcgaccgcagcttcagcaagctgaggaagacggtgtatcattcaagcagtgtgttcagcaacttgagcgcaagctggacctcaaaacccccattggcagtcaaatacaagctcgatgcatctaccctgaatgatgaacaaggcggcctcaagagcctctgctccactctagaccgactcctcgcttgggaaaagaagctttatgaggatgtcaaggcaagagaaggagttaagattgagcacgagaagaagctgtctgcgctgcagagtcaggagtataagggaggtgatgaatccaagctagacaagactaaaacttccataaccagactgcaatcactcatcattgtttcttcagaagctgttttaaccacgtctaatgccattctccgcctccgggacactgaccttgtccctcagcttgttgaactctgccacggattaatgtacatgtggaagtcaatgcacgagtatcacgaaatccagaacaacatcgtgcaacaagtccgtggcctgatcaaccaaacagagagaggtgagtcaacatcagaggtacaccggcaggtgacgcgggacctagagtcagctgtgtccttgtggcattcgagcttctgtcgcatcattaaattccagagggagttcatatgctctctccacgcatggttcaagctgagcctggttcccctgagcaacggagacccaaagaaacagcggccagactcatttgccttgtgcgaggagtggaagcagagcctggaacgggtgcctgacacagtggcgtcagaagccataaagagctttgtaaacgtggtacatgtgatatcaataaagcaggcggaagaggtgaagatgaagaaacgcacggagagtgcaggaaaggagctggagaagaaagcatcctcactgaggagcatagagaggaagtactaccaggcatactcgacggttgggataggccctggaccggaggtgttggactcacgggacccgctatctgagaagaaatgtgagctggcggcatgtcagaggcaggtggaggatgaggtaatgaggcacgtgaaggctgtggaggtgacacgagctatgactctcaacaatctacaaaccggcctgcccaatgtattccaggccttgaccagcttctcatctctcttcactgaatctctccagactgtctgttctcgttcctactccatcaactgattatgtccaagtttctcatttatttttaagctctcattacgttggtatcatgtaaatttgaggattgattaaattgagtcttgtggttttgtgaggactcacaatctttctcatttaaaaaaaaaaaaaaaaaaa

SEQ ID NO: 208 - protein, 703 aa, Arabidopsis thaliana
MGCTASKLDSEDAVRRCKERRRLMKDAVYARHHLAAAHSDYCRSLRLTGSALSSFAAGEPLSVSENTPAVFLRPSSSQDAPRVPSSHSPEPPPPPIRSKPKPTRPRRLPHILSDSSPSSSPATSFYPTAHQNSTYSRSPSQASSVWNWENFYPPSPPDSEYFERKARQNHKHRPPSDYDAETERSDHDYCHSRRDAAEEVHCSEWGDDHDRFTATSSSDGDGEVETHVSRSGIEEEPVKQPHQDPNGKEHSDHVTTSSDCYKTKLVVRHKNLKEILDAVQDYFDKAASAGDQVSAMLEIGRAELDRSFSKLRKTVYHSSSVFSNLSASWTSKPPLAVKYKLDASTLNDEQGGLKSLCSTLDRLLAWEKKLYEDVKAREGVKIEHEKKLSALQSQEYKGGDESKLDKTKTSITRLQSLIIVSSEAVLTTSNAILRLRDTDLVPQLVELCHGLMYMWKSMHEYHEIQNNIVQQVRGLINQTERGESTSEVHRQVTRDLESAVSLWHSSFCRIIKFQREFICSLHAWFKLSLVPLSNGDPKKQRPDSFALCEEWKQSLERVPDTVASEAIKSFVNVVHVISIKQAEEVKMKKRTESAGKELEKKASSLRSIERKYYQAYSTVGIGPGPEVLDSRDPLSEKKCELAACQRQVEDEVMRHVKAVEVTRAMTLNNLQTGLPNVFQALTSFSSLFTESLQTVCSRSYSIN

SEQ ID NO: 209 - DNA, 786 bp, Arabidopsis thaliana
atggtgtttaaatcagaaaaatcaaaccgggaaatgaaatcaaaggagaagcaaaggaagggattatggtcacccgaggaagatgagaagcttaggagtcatgtcctcaaatatggccatggatgctggagtactattcctcttcaagctggattgcagaggaatgggaagagttgtagattaaggtgggttaattatttaagacctggacttaagaagtctttattcactaaacaagaggaaactatacttctttcacttcattccatgttgggtaacaaatggtctcagatatcgaaattcttaccaggaagaaccgacaacgagatcaaaaactattggcattctaatctaaagaagggtgtaactttgaaacaacatgaaaccacaaaaaaacatcaaacacctttaatcacaaactcacttgaggccttgcagagttcaactgaaagatcttcttcatctatcaatgtcggagaaacgtctaatgctcaaacctcaagcttttcgccaaatctcgtgttctcggaatggttagatcatagtttgcttatggatcagtcacctcaaaagtctagctatgttcaaaatcttgttttaccggaagagagaggattcattggaccatgtggccctcgttatttgggaaacgactctttgcctgatttcgtgccaaattcagaatttttgttggatgatgagatatcatctgagatcgagttctgtacttcattttcagacaactttttgttcgatggtctcatcaacgagctacgaccaatgtaa

SEQ ID NO: 210 - protein, 261 aa, Arabidopsis thaliana
MVFKSEKSNREMKSKEKQRKGLWSPEEDEKLRSHVLKYGHGCWSTIPLQAGLQRNGKSCRLRWVNYLRPGLKKSLFTKQEETILLSLHSMLGNKWSQISKFLPGRTDNEIKNYWHSNLKKGVTLKQHETTKKHQTPLITNSLEALQSSTERSSSSINVGETSNAQTSSFSPNLVFSEWLDHSLLMDQSPQKSSYVQNLVLPEERGFIGPCGPRYLGNDSLPDFVPNSEFLLDDEISSEIEFCTSFSDNFLFDGLINELRPM

SEQ ID NO: 211 - DNA, 513 bp, Arabidopsis thaliana
atggcgactcaagattctcaagggattaaactctttggcaaaactattgcatttaacactcgaacaataaaaaatgaagaagagacacacccgccggagcaagaagccacaatagccgttagatcatcatcatcatcggatctgacggccgagaagcgtccggataagatcatagcatgtccaagatgcaagagcatggagacaaagttctgttacttcaacaactacaacggtaatcagcctcgacacttttgtaaaggctgccaccgttactggaccgccggtggtgcactccggaacgttcccgtcggcgccggtcgtcggaagtccaaaccacctggtcgtgtcgtggttggtatgcttggagatggaaatggtgttcgccaagtcgagcttataaatggcttgctcgttgaggagtggcagcatgccgcagccgcagctcacggtagtttccggcatgattttcccatgaagcggctccggtgttactccgacggtcaatcgtgctga

SEQ ID NO: 212 - protein, 170 aa, Arabidopsis thaliana
MATQDSQGIKLFGKTIAFNTRTIKNEEETHPPEQEATIAVRSSSSSDLTAEKRPDKIIACPRCKSMETKFCYFNNYNGNQPRHFCKGCHRYWTAGGALRNVPVGAGRRKSKPPGRVVVGMLGDGNGVRQVELINGLLVEEWQHAAAAAHGSFRHDFPMKRLRCYSDGQSC

SEQ ID NO: 213 - DNA, 1673 bp, Arabidopsis thaliana
cccgggtcgacccacgcgtccgctctctctctctgaactatacaaaaacctacttttaatttctcttccaagaagtcaagaacccagaagaagacatgacaagtgaagttcttcaaacaatctcaagtggatcaggttttgctcagccacagagctcatcaaccctggatcatgatgaatctctcatcaatcctcctcttgttaagaaaaagagaaatctccctggaaatcctgatccggaagctgaagtgatagctttatcccccacgaccttgatggctacgaaccggttcctatgtgaggtatgtggcaaaggtttccaaagagaccaaaacttacagcttcatcggcgaggacataatcttccatggaagttgaagcagaggacaagcaaagaagtgagaaaacgtgtctacgtttgccccgagaagacatgtgtccaccatcactcctctagagctctaggcgatctcactggaatcaaaaagcatttttgccggaaacacggggagaagaagtggacgtgcgagaaatgtgctaagagatacgcagtccaatctgattggaaagctcattccaagacttgtggtactagagagtaccgttgcgattgtggcaccattttctcaaggcgagacagctttatcactcatagagctttctgcgatgccttagcggaagaaaccgctaagataaacgcagtgtctcatctcaacggtttagccgcggctggagccccaggatcagttaatctcaactatcaatatctcatgggaacattcatcccaccgcttcaaccatttgtaccacaaccgcaaacaaatccaaaccatcatcatcaacattttcagccaccaacttcttcgtcgctctctctatggatgggacaagatatcgcgccgcctcaaccgcaaccggactacgattgggtttttggaaacgctaaggcagcgtctgcttgcattgataataataatactcacgatgagcagattacgcaaaacgcaaacgcaagtttgaccactaccactactctctctgccccttctttattcagcagcgaccaaccacaaaacgcaaacgcaaattcaaacgtgaatatgtccgcgacagctttactacagaaagctgctgaaattggcgctacttctacaacaaccgcagcgaccaatgacccatcaacgtttcttcaaagtttcccgcttaaatccaccgatcaaaccaccagttatgacagtggcgaaaagttttttgctttgttcgggtctaacaacaacattgggttaatgagtcgtagtcatgatcatcaagagatcgagaacgctagaaatgacgttacggttgcgtctgccttggatgaattacagaattacccttggaaacgtagaagagttgatggtggaggtgaagtgggtggaggagggcaaactcgggatttcctcggggttggtgtacaaacgttgtgccatccatcgtctatcaatggatggatttgaaagagtttaaaaatttcggggttaatgcataaattacgtaaaagaagaaggaatcttttgtcatttccaccattttctaagataacatatgtatatggtaatggaagttgttttcttttattaattcaatattctaaaacttatgatatatgtataatgaatgtgtttatcttcaaa

SEQ ID NO: 214 - protein, 466 aa, Arabidopsis thaliana
MTSEVLQTISSGSGFAQPQSSSTLDHDESLINPPLVKKKRNLPGNPDPEAEVIALSPTTLMATNRFLCEVCGKGFQRDQNLQLHRRGHNLPWKLKQRTSKEVRKRVYVCPEKTCVHHHSSRALGDLTGIKKHFCRKHGEKKWTCEKCAKRYAVQSDWKAHSKTCGTREYRCDCGTIFSRRDSFITHRAFCDALAEETAKINAVSHLNGLAAAGAPGSVNLNYQYLMGTFIPPLQPFVPQPQTNPNHHHQHFQPPTSSSLSLWMGQDIAPPQPQPDYDWVFGNAKAASACIDNNNTHDEQITQNANASLTTTTTLSAPSLFSSDQPQNANANSNVNMSATALLQKAAEIGATSTTTAATNDPSTFLQSFPLKSTDQTTSYDSGEKFFALFGSNNNIGLMSRSHDHQEIENARNDVTVASALDELQNYPWKRRRVDGGGEVGGGGQTRDFLGVGVQTLCHPSSINGWI

SEQ ID NO: 215 - DNA, 858 bp, Arabidopsis thaliana
ttagggttttagaaagatagatcgattgaagatgaggaaaggtaagagagtgataaaaaagatagaggagaaaataaagagacaagtgacattcgcaaagagaaagaagagtctaatcaagaaggcatatgaactctctgttctctgcgatgtccaccttggtctcatcatcttctctcactccaacaggctctacgatttctgctccaactctaccagcatggagaatctcatcatgagataccaaaaggaaaaagaaggtcaaaccactgcagaacacagtttccactcggatcagtgttcagattgcgtgaagacgaaggaatcaatgatgagagagatagagaatcttaagctgaatcttcaattgtacgacggacatggcttgaatctcttgacctacgacgagctcctttcttttgagctccatctcgaatcttctctacaacatgctcgagctcgcaagtctgagttcatgcatcagcagcagcagcaacaaacagatcaaaagcttaagggaaaagaaaagggtcaaggaagctcttgggagcagctgatgtggcaagcagagagacagatgatgacgtgtcaaagacaaaaagatcctgcgccggcgaatgaaggaggagttccttttttacggtggggaacaacccaccgacgttcttcacctccttaagctaccacaaccaggcccaaatacaggcccataacttctctctatctataaaaaacaactgatagtaaaaagtattgacccggtttggttcggttatgttgataccagactattaattaacttcggttagacgtatttacgacttgatgctatctagacctttttgcccttcaaaaaaa

SEQ ID NO: 216 - protein, 215 aa, Arabidopsis thaliana
MRKGKRVIKKIEEKIKRQVTFAKRKKSLIKKAYELSVLCDVHLGLIIFSHSNRLYDFCSNSTSMENLIMRYQKEKEGQTTAEHSFHSDQCSDCVKTKESMMREIENLKLNLQLYDGHGLNLLTYDELLSFELHLESSLQHARARKSEFMHQQQQQQTDQKLKGKEKGQGSSWEQLMWQAERQMMTCQRQKDPAPANEGGVPFLRWGTTHRRSSPP

SEQ ID NO: 217 - DNA, 1130 bp, Arabidopsis thaliana
  misc_feature (1100)..(1100): n=a,t,c or g
ccaagatcgactcttacttcgaatctctctcaactttcttcctcagcttacgggaacttccacacatatacatccacaagaacccatatcgaagattcatcctacatatatttacatggatcagtactcatcctctttggtcgatacttcattagatctcactattggcgttactcgtatgcgagttgaagaagatccaccgacaagtgctttggtggaagaattaaaccgagttagtgctgagaacaagaagctctcggagatgctaactttgatgtgtgacaactacaacgtcttgaggaagcaacttatggaatatgttaacaagagcaacataaccgagagggatcaaatcagccctcccaagaaacgcaaatccccggcgagagaggacgcattcagctgcgcggttattggcggagtgtcggagagtagctcaacggatcaagatgagtatttgtgtaagaagcagagagaagagactgtcgtgaaggagaaagtctcaagggtctattacaagaccgaagcttctgacactaccctcgttgtgaaagatgggtatcaatggaggaaatatggacagaaagtgactagagacaatccatctccaagagcttacttcaaatgtgcttgtgctccaagctgttctgtcaaaaagaaggttcagagaagtgtggaggatcagtccgtgttagttgcaacttatgagggtgaacacaaccatccaatgccatcgcagatcgattcaaacaatggcttaaaccgccacatctctcatggtggttcagcttcaacacccgttgcagcaaacagaagaagtagcttgactgtgccggtgactaccgtagatatgattgaatcgaagaaagtgacgagcccaacgtcaagaatcgattttccccaagttcagaaacttttggtggagcaaatggcttcttccttaaccaaagatcctaactttacagcagctttagcagcagctgttaccggaaaattgtatcaacagaatcataccgagaaatagtttagcttcaaattccgttagagtttttagatttgaatttgtcatgagtaagagaaagagagtagattataatccnttgtgatactgaaaaaaaaaaaaaaaaaaa

SEQ ID NO: 218 - protein, 302 aa, Arabidopsis thaliana
MDQYSSSLVDTSLDLTIGVTRMRVEEDPPTSALVEELNRVSAENKKLSEMLTLMCDNYNVLRKQLMEYVNKSNITERDQISPPKKRKSPAREDAFSCAVIGGVSESSSTDQDEYLCKKQREETVVKEKVSRVYYKTEASDTTLVVKDGYQWRKYGQKVTRDNPSPRAYFKCACAPSCSVKKKVQRSVEDQSVLVATYEGEHNHPMPSQIDSNNGLNRHISHGGSASTPVAANRRSSLTVPVTTVDMIESKKVTSPTSRIDFPQVQKLLVEQMASSLTKDPNFTAALAAAVTGKLYQQNHTEK

SEQ ID NO: 219 - DNA, 1449 bp, Arabidopsis thaliana
atggtggctatgtttcaagaagataatggaacatcttctgtagcttcatcaccacttcaagtcttctcaactatgtcactcaacagaccgactctcctcgcttcttcatctccgtttcattgtctcaaagatctcaaaccagaggagcgtggtctctacttaatccacctcttgctaacttgtgccaaccacgtggcttcaggtagcctccaaaacgctaacgcagcgctcgagcagctctctcacctcgcttctcctgacggcgacacgatgcagcgaatcgctgcttacttcaccgaagcgcttgctaacagaatccttaagtcctggcctggtctttacaaggctcttaacgcaactcagacaagaactaacaatgtctctgaggagattcatgttagaagactcttctttgagatgttcccgatactcaaagtctcttacttgctcactaatcgagctatactcgaggctatggaaggagagaagatggttcatgtgattgatctcgatgcttctgagccagctcaatggcttgctttgcttcaagcttttaactctaggcctgaaggtccacctcatttgagaatcactggtgttcatcaccagaaggaagtgcttgaacaaatggctcatagactcattgaggaagcagagaaactcgatatcccgtttcagtttaatcccgttgtgagtaggttagactgtttaaatgtagaacagttgcgggttaaaacaggagaggccttagccgttagctcggttcttcaattgcataccttcttggcctctgatgatgatctcatgagaaagaactgcgctttacggtttcagaacaaccctagtggagttgacttgcagagagttctaatgatgagccatggctctgcagctgaggcacgtgagaatgatatgagtaacaacaatgggtatagccctagcggtgactcggcctcatctttgcctttaccaagttcaggaaggactgatagcttcctcaatgctatttggggtttgtctccaaaggtcatggtggtcactgagcaagactcagaccacaacggctccacactaatggagaggctattagaatcactttacacctacgcagcattgtttgattgcttggaaacaaaagttccaagaacgtctcaagataggatcaaagtggagaagatgctcttcggggaggagatcaagaacatcatatcctgcgagggatttgagagaagagaaagacacgagaagcttgagaaatggagccagaggatcgatttggctggttttgggaatgttcctcttagctattatgcgatgttgcaggctaggagattgcttcaagggtgcggttttgatgggtatagaatcaaggaagagagcgggtgcgcagtaatttgctggcaagatcgacctctatactcggtatcagcttggagatgcaggaagtga

SEQ ID NO: 220 - protein, 482 aa, Arabidopsis thaliana
MVAMFQEDNGTSSVASSPLQVFSTMSLNRPTLLASSSPFHCLKDLKPEERGLYLIHLLLTCANHVASGSLQNANAALEQLSHLASPDGDTMQRIAAYFTEALANRILKSWPGLYKALNATQTRTNNVSEEIHVRRLFFEMFPILKVSYLLTNRAILEAMEGEKMVHVIDLDASEPAQWLALLQAFNSRPEGPPHLRITGVHHQKEVLEQMAHRLIEEAEKLDIPFQFNPVVSRLDCLNVEQLRVKTGEALAVSSVLQLHTFLASDDDLMRKNCALRFQNNPSGVDLQRVLMMSHGSAAEARENDMSNNNGYSPSGDSASSLPLPSSGRTDSFLNAIWGLSPKVMVVTEQDSDHNGSTLMERLLESLYTYAALFDCLETKVPRTSQDRIKVEKMLFGEEIKNIISCEGFERRERHEKLEKWSQRIDLAGFGNVPLSYYAMLQARRLLQGCGFDGYRIKEESGCAVICWQDRPLYSVSAWRCRK

SEQ ID NO: 221 - DNA, 1519 bp, Arabidopsis thaliana
ccacgcgtccgaccacttgtacctctttgtcttaagtactctttaaccctacaatttcctaagctctcaagccacaaaaaaccacaaaccgttcttcaccaatatatatatctgatcatcatcaaagtccttctctctgctcataccacaaaccgttccattcttcccctaatcacaaagtgatatttacatagagaagatagagatgggaagaccaccatgctgtgacaagattggagtgaagaaaggaccatggacaccagaggaagatatcatcttggtttcttacatccaagaacatggtcctggaaactggagatctgtgcctactcacacaggtttgaggagatgtagcaaaagctgtagattgaggtggactaattatcttcgacctgggatcaagcgtggaaatttcaccgagcatgaagagaagatgattctccatcttcaagctcttttgggaaacaggtgggcagctatagcatcatatcttccagaaaggacagacaatgatataaagaactattggaacactcatttgaagaaaaagctcaagaagatgaatgattcttgtgatagtactatcaacaatggccttgataataaagacttctccatatcaaacaaaaacactacctcacatcaaagcagcaactccagtaaaggtcaatgggagagaaggcttcagacagatatcaacatggctaaacaagctctttgtgatgccttgtctattgacaaaccacaaaacccaactaatttttctattcccgatcttggttatggtccatcatcttcttcgtcctctaccaccaccaccaccaccaccaccaccacgagaaacactaatccatacccatctggggtctatgcttcaagtgctgagaacattgctcgtttgcttcagaattttatgaaagacacaccaaagacctcggtgcccttgccggttgcagccaccgagatggctatcaccacggcagcttcgagccctagcacaaccgaaggagacggagaagggattgaccattctttgttcagcttcaactccatagatgaagctgaagagaagcctaaactaatagaccatgacattaatggtctaattacacaaggctctctttctttgttcgagaaatggctctttgatgagcaaagccacgatatgatcatcaataacatgtcactagagggtcaggaagtgttgttctagaaagcattaaagtttgacgatttgcttgaggaaccacgaggcttagttataaacaatttgtataattaagtactctttagttttgttttcaatccttattatgatcatattgcagtaattagggattttagtctttagtagtaactcttaagttttaacacatttttctctatctttttagtagtaactctttattttttccttaaatctttgtcgacgtggagatgatatcttctatgtagtagaaactcaaaagtgtacatcatctttattaatgtaacgtctttttaaaaaaaaaaaaaaaaa

SEQ ID NO: 222 - protein, 335 aa, Arabidopsis thaliana
MGRPPCCDKIGVKKGPWTPEEDIILVSYIQEHGPGNWRSVPTHTGLRRCSKSCRLRWTNYLRPGIKRGNFTEHEEKMILHLQALLGNRWAAIASYLPERTDNDIKNYWNTHLKKKLKKMNDSCDSTINNGLDNKDFSISNKNTTSHQSSNSSKGQWERRLQTDINMAKQALCDALSIDKPQNPTNFSIPDLGYGPSSSSSSTTTTTTTTTTRNTNPYPSGVYASSAENIARLLQNFMKDTPKTSVPLPVAATEMAITTAASSPSTTEGDGEGIDHSLFSFNSIDEAEEKPKLIDHDINGLITQGSLSLFEKWLFDEQSHDMIINNMSLEGQEVLF

SEQ ID NO: 223 - DNA, 1857 bp, Arabidopsis thaliana
tcgacagaacagcttcgttgtcacttgtcattctataaatcgcatccccattgacaacctttcacttccatcaaaactctctctctatatctctctctctatatatctctctctatatctctctctctcttcactctctctttctttcaaaatggaaaaactcatggttccgacatggagacccgacccggtttaccgtccaccggaaacaccactcgaaccgatggagtttttagctcgttcatggagcgtctctgctctcgaagtctccaaggctctaacaccacccaaccctcagattctcctctccaaaaccgaagaagaagaagaagaagaacccatctcctctgtcgtagacggcgacggcgacacggaagacaccggacttgtcaccggaaacccattctccttcgcttgttcagaaacttctcaaatggtcatggatcgtatcttgtctcactctcaagaagtatcaccaagaacatctggtcggctatctcacagtagtggtccacttaatggttctttgaccgacagtcctcctgtgtctcctcccgaatccgacgacattaagcaattttgcagagcgaacaaaaattcattgaacagtgtaaattctcagttccgttcaacggcggcaactccgggacctataaccgctacagctacacagtccaagacggtgggacggtggcttaaggaccggagagagaaaaagaaagaggagactcgggctcataacgctcagattcacgctgctgtctctgtcgccggcgttgctgcagctgttgctgctattgcagcagccaccgctgcgtcttctagctgtggtaaggatgagcagatggctaaaactgacatggccgttgcttctgctgcgacccttgtggctgctcagtgtgtggaagctgctgaagttatgggagctgagagagagtatttggcttctgttgttagctccgccgtcaatgttcgttctgccggagatattatgactctcaccgccggagcagctacagctttaagaggagtgcaaacattgaaggcaagggcaatgaaggaagtgtggaacatagcatcagtgataccaatggataaaggactcacttctacaggaggaagcagcaataatgttaatggtagcaatggaagctcaagcagtagtcacagtggtgaacttgtacaacaggagaatttcttgggaacttgtagtagagaatggctcgctagaggttgtgaactcctcaaacgcactcgcaaaggtgatctccactggaagatagtatctgtttacatcaacaaaatgaatcaggttatgttgaagatgaagagcaggcatgttggaggaaccttcaccaagaagaaaaagaacattgtgcttgatgtgatcaagaatgtcccggcctggcctggacgacatttgctagagggaggagatgatctaagatacttcggtttgaagacggttatgcgaggtgatgttgaattcgaggtcaagagccaaagggaatatgaaatgtggacacaaggtgtctcaaggcttcttgttcttgctgctgagaggaagtttaggatgtgaataaacgttcaatggctgcttggtttaagtgtgagtttttttttaacttatgtggtcaaatttcattagtaggggttcttttaaggtaatggttttttgggttgggtataggataaaatggacctaccagtcaaggtgaggaagcatttgggtaaacaaaacttagtgggggtgatctgtaatatctatgttcttagtttttttttggttgttggtggtctttttgtataaaaaaacaaagttgaagtaatagatatatagtatgttttaattttaaa

SEQ ID NO: 224 - protein, 475 aa, Arabidopsis thaliana
MEKLMVPTWRPDPVYRPPETPLEPMEFLARSWSVSALEVSKALTPPNPQILLSKTEEEEEEEPISSVVDGDGDTEDTGLVTGNPFSFACSETSQMVMDRILSHSQEVSPRTSGRLSHSSGPLNGSLTDSPPVSPPESDDIKQFCRANKNSLNSVNSQFRSTAATPGPITATATQSKTVGRWLKDRREKKKEETRAHNAQIHAAVSVAGVAAAVAAIAAATAASSSCGKDEQMAKTDMAVASAATLVAAQCVEAAEVMGAEREYLASVVSSAVNVRSAGDIMTLTAGAATALRGVQTLKARAMKEVWNIASVIPMDKGLTSTGGSSNNVNGSNGSSSSSHSGELVQQENFLGTCSREWLARGCELLKRTRKGDLHWKIVSVYINKMNQVMLKMKSRHVGGTFTKKKKNIVLDVIKNVPAWPGRHLLEGGDDLRYFGLKTVMRGDVEFEVKSQREYEMWTQGVSRLLVLAAERKFRM

SEQ ID NO: 225 - DNA, 1263 bp, Arabidopsis thaliana
atactccaagaatttataggttataagtaaaaattcagtacaagtttgtttgtttgtttattccattttcttgtgtgtttttttccccataatttataaattttataagcaatatggagtcccacaacaacaaccagagcaacaacaacaccactggttcggcccatctggtcccatccatgggaccaatctccggttcagtctcattaaccaccactgctccaaactccactaccaccaccgtcaccgccgctaaaacacccgcaaaacgaccgtccaaggaccgtcacatcaaagtagacggacgtggccggaggatacgtatgccggctatctgcgcagcacgtgtcttccaactaacacgtgagttacaacacaaatcggacggcgagactatagagtggctgctccaacaagcggagccagctatcatcgcagccaccggaactggaaccataccggcgaatatctctactttgaacatctctcttcgaagcagtggctctactctttcagctccactgtctaaatctttccacatgggaagagcggctcaaaacgctgccgtttttgggttccagcaacagctttatcatcctcatcatatcacgacagattcttcttcttcttctcttcccaaaacattccgtgaagaagatctttttaaagatcctaattttctagatcaagaacccggttcaagatcacctaaaccgggatccgaagctcctgatcaagatccgggttcgacccggtcaagaacacaaaatatgataccgccgatgtgggcactagcgccaacgccagcctccacaaacggaggtagtgctttttggatgttaccagtcggaggaggaggaggtccggctaacgttcaggatccatcacagcacatgtgggcgtttaatccgggtcattacccgggtcgaatcgggtcggttcagctagggtctatgttagtgggaggtcaacagttagggttaggtgttgcagaaaataacaatttggggctattttccggcggaggaggagacggtggtcgggttggtctcggaatgagtcttgagcaaaagcctcaacatcaagtgagtgatcatgctactagagaccaaaatcctactatagatggttctccttgaaagacttcatgatttctttggtttttaaaaagtgtgaatgtgtgatttattgcaacttttgttgaggactccaatgttaatatgggttttagggttggcttttcgggattgccaaattgttatt

SEQ ID NO: 226 - protein, 341 aa, Arabidopsis thaliana
MESHNNNQSNNNTTGSAHLVPSMGPISGSVSLTTTAPNSTTTTVTAAKTPAKRPSKDRHIKVDGRGRRIRMPAICAARVFQLTRELQHKSDGETIEWLLQQAEPAIIAATGTGTIPANISTLNISLRSSGSTLSAPLSKSFHMGRAAQNAAVFGFQQQLYHPHHITTDSSSSSLPKTFREEDLFKDPNFLDQEPGSRSPKPGSEAPDQDPGSTRSRTQNMIPPMWALAPTPASTNGGSAFWMLPVGGGGGPANVQDPSQHMWAFNPGHYPGRIGSVQLGSMLVGGQQLGLGVAENNNLGLFSGGGGDGGRVGLGMSLEQKPQHQVSDHATRDQNPTIDGSP

SEQ ID NO: 227 - DNA, 2026 bp, Arabidopsis thaliana
caaaaaaaaagtttcaatttttgaaagctctgagaaatgaaatctatcattctctctctctatctctatcttccttttcagatttcgcttcttcaattcatgaaatcctcgtgattctactttaatgcttctctttttttacttttccaagtctctgaatattcaaagtatatatcttttgttttcaaacttttgcagaattgtcttcaagcttccaaatttcagttaaaggtctcaactttgcagaattttcctctaaaggttcagactttggggtaaaggtgtcaactttggcgatgggtcttgacggaaacaatggtggaggggtttggttaaacggtggtggtggagaaagggaagagaacgaggaaggttcatggggaaggaatcaagaagatggttcttctcagtttaagcctatgcttgaaggtgattggtttagtagtaaccaaccacatccacaagatcttcagatgttacagaatcagccagatttcagatactttggtggttttccttttaaccctaatgataatcttcttcttcaacactctattgattcttcttcttcttgttctccttctcaagcttttagtcttgacccttctcagcaaaatcagttcttgtcaactaacaacaacaagggttgtcttctcaatgttccttcttctgcaaacccttttgataatgcttttgagtttggctctgaatctggttttcttaaccaaatccatgctcctatttcgatggggtttggttctttgacacaattggggaacagggatttgagttctgttcctgatttcttgtctgctcggtcacttcttgcgccggaaagcaacaacaacaacacaatgttgtgtggtggtttcacagctccgttggagttggaaggttttggtagtcctgctaatggtggttttgttgggaacagagcgaaagttctgaagcctttagaggtgttagcatcgtctggtgcacagcctactctgttccagaaacgtgcagctatgcgtcagagctctggaagcaaaatgggaaattcggagagttcgggaatgaggaggtttagtgatgatggagatatggatgagactgggattgaggtttctgggttgaactatgagtctgatgagataaatgagagcggtaaagcggctgagagtgttcagattggaggaggaggaaagggtaagaagaaaggtatgcctgctaagaatctgatggctgagaggagaaggaggaagaagcttaatgataggctttatatgcttagatcagttgtccccaagatcagcaaaatggatagagcatcaatacttggagatgcaattgattatctgaaggaacttctacaaaggatcaatgatcttcacaatgaacttgagtcaactcctcctggatctttgcctccaacttcatcaagcttccatccgttgacacctacaccgcaaactctttcttgtcgtgtcaaggaagagttgtgtccctcttctttaccaagtcctaaaggccagcaagctagagttgaggttagattaagggaaggaagagcagtgaacattcatatgttctgtggtcgtagaccgggtctgttgctcgctaccatgaaagctttggataatcttggattggatgttcagcaagctgtgatcagctgttttaatgggtttgccttggatgttttccgcgctgagcaatgccaagaaggacaagagatactgcctgatcaaatcaaagcagtgcttttcgatacagcagggtatgctggtatgatctgatctgatcctgacttcgagtccattaagcatctgttgaagcagagctagaagaactaagtccctttaaatctgcaattttcttctcaactttttttcttatgtcataacttcaatctaagcatgtaatgcaattgcaaatgagagttgtttttaaattaagcttttgagaacttgaggttgttgttgttggatacataacttcaaccttttattagcaatgttaacttccatttatgtttcatctt

SEQ ID NO: 228 - protein, 494 aa, Arabidopsis thaliana
MGLDGNNGGGVWLNGGGGEREENEEGSWGRNQEDGSSQFKPMLEGDWFSSNQPHPQDLQMLQNQPDFRYFGGFPFNPNDNLLLQHSIDSSSSCSPSQAFSLDPSQQNQFLSTNNNKGCLLNVPSSANPFDNAFEFGSESGFLNQIHAPISMGFGSLTQLGNRDLSSVPDFLSARSLLAPESNNNNTMLCGGFTAPLELEGFGSPANGGFVGNRAKVLKPLEVLASSGAQPTLFQKRAAMRQSSGSKMGNSESSGMRRFSDDGDMDETGIEVSGLNYESDEINESGKAAESVQIGGGGKGKKKGMPAKNLMAERRRRKKLNDRLYMLRSVVPKISKMDRASILGDAIDYLKELLQRINDLHNELESTPPGSLPPTSSSFHPLTPTPQTLSCRVKEELCPSSLPSPKGQQARVEVRLREGRAVNIHMFCGRRPGLLLATMKALDNLGLDVQQAVISCFNGFALDVFRAEQCQEGQEILPDQIKAVLFDTAGYAGMI

SEQ ID NO: 229 - DNA, 1011 bp, Arabidopsis thaliana
aaagttattgatagtttctgttacttattaatttttaaggttatgtgtattattaccaattggaggactatatagtcgcaagtctcaaccctataaaagaaaacattcgtcgatcatcttcccgcctcgagtatctctctctctctctctcttctctgttttctttattgattgcatagacaaaaatacacacatacacaacagaaagaaagatggagacgacgatgaagaagaaagggagagtgaaagcgacaataacgtcacagaaagaagaagaaggaacagtgagaaaaggaccttggactatggaagaagatttcatcctctttaattacatccttaatcatggtgaaggtctttggaactctgtcgccaaagcctctggtctaaaacgtactggaaaaagttgtcggctccggtggctgaactatctccgaccagatgtgcggcgagggaacataaccgaagaagaacagcttttgatcattcagcttcatgctaagcttggaaacaggtggtcgaagattgcgaagcatcttccgggaagaacggacaacgagataaagaacttctggaggacaaagattcagagacacatgaaagtgtcatcggaaaatatgatgaatcatcaacatcattgttcgggaaactcacagagctcggggatgacgacgcaaggcagctccggcaaagccatagacacggctgagagcttctctcaggcgaagacgacgacgtttaatgtggtggaacaacagtcaaacgagaattactggaacgttgaagatctgtggcccgtccacttgcttaatggtgaccaccatgtgatttaagatatatatatagacctcctatacatttatatgccccagctgggtttttttgtatggtacgttatttggtttttctattgctgaaatgtcgttgcatttaatttacatacgaaaagtgcattaaatcattaaatcttcaatacatatggaggtggtgtttgagtaaaaaaaaaaaaaa

SEQ ID NO: 230 - protein, 206 aa, Arabidopsis thaliana
METTMKKKGRVKATITSQKEEEGTVRKGPWTMEEDFILFNYILNHGEGLWNSVAKASGLKRTGKSCRLRWLNYLRPDVRRGNITEEEQLLIIQLHAKLGNRWSKIAKHLPGRTDNEIKNFWRTKIQRHMKVSSENMMNHQHHCSGNSQSSGMTTQGSSGKAIDTAESFSQAKTTTFNVVEQQSNENYWNVEDLWPVHLLNGDHHVI

SEQ ID NO: 231 - DNA, 786 bp, Arabidopsis thaliana
atggtggaagaagtttggagaaagggtccatggaccgccgaagaagaccgtcttttgatcgaatacgtccgtgttcacggtgaaggtcgttggaactctgtctctaaactcgcaggattgaaaaggaatggcaaaagctgcagactaagatgggtgaattaccttagaccagacctcaagagaggacagatcactccacatgaagaaagtataatacttgagctacacgctaagtggggaaataggtggtcaacaattgcacgtagtttaccaggaagaacagacaatgagatcaagaactattggagaacccatttcaagaaaaaggcaaagcctacgactaacaatgcggagaagataaagagtcgtctcctaaaaaggcaacacttcaaggaacagagagaaatagagttgcaacaagaacagcagttgtttcagttcgaccaactcggtatgaaaaagatcatctctttactcgaagaaaacaatagcagtagcagtagcgatggcggtggtgatgtgttctattatcctgatcaaataacacattcatcaaaaccctttggctataactctaattcattagaggagcagttacaaggtagattttctcctgtaaacatacctgatgctaatactatgaacgaagacaatgccatatgggacgggttttggaacatggatgttgtaaatggacatggtgggaacttgggtgttgtggctgctactgctgcttgtggcccaaggaagccctatttccataacttggtgattccattttgttaa

SEQ ID NO: 232 - protein, 261 aa, Arabidopsis thaliana
MVEEVWRKGPWTAEEDRLLIEYVRVHGEGRWNSVSKLAGLKRNGKSCRLRWVNYLRPDLKRGQITPHEESIILELHAKWGNRWSTIARSLPGRTDNEIKNYWRTHFKKKAKPTTNNAEKIKSRLLKRQHFKEQREIELQQEQQLFQFDQLGMKKIISLLEENNSSSSSDGGGDVFYYPDQITHSSKPFGYNSNSLEEQLQGRFSPVNIPDANTMNEDNAIWDGFWNMDVVNGHGGNLGVVAATAACGPRKPYFHNLVIPFC

SEQ ID NO: 233 - DNA, 891 bp, Arabidopsis thaliana
atgcctccattaccgtcctccacggcgccttcgtcttcgagacatcttcgatcgccggaaagtatcgcgaaatttgcagggagagcaatatttcctgctttacaggggaaatcgtgtccgatatgcctcgaaaatctaaccgagcgaagatccgccgccgtgatcacggtgtgcaagcacggatactgccttgcttgtattcggaagtggagcagcttcaagaggaattgtcctctttgtaacactcgttttgattcctggtttatcgttagtgattttgcttctagaaaataccataaggagcaattaccaattcttcgtgatcgtgagactttaacttatcatcggaataatccttccgatcgccggaggataattcaaaggtcgagggatgttttggaaaactctagctcaagatcaaggccattgccatggcggagatcatttggacgaccaggttcagttcctgattctgttatcttccagcgaaagcttcagtggcgagctagcatatacactaagcaattacgagctgttcgattacattcaaggcgcttggaactaagtttggcggtgaatgattacaccaaagcaaagataactgaaagaattgagccatggattagaagagagcttcaggcagtccttggagatcctgatccctcagttattgttcattttgcgtcagctcttttcatcaaaaggcttgagagagagaataatcgacaaaccgggcagaccgggatgttggtggaagatgaagtctcctctcttcgaaaattcttgtctgataaggtggatatattttggcatgaactaagatgttttgcggagagtatactcacgatggagacttatgatgcagtggttgaatacaatgaggtggagtaa

SEQ ID NO: 234 - protein, 296 aa, Arabidopsis thaliana
MPPLPSSTAPSSSRHLRSPESIAKFAGRAIFPALQGKSCPICLENLTERRSAAVITVCKHGYCLACIRKWSSFKRNCPLCNTRFDSWFIVSDFASRKYHKEQLPILRDRETLTYHRNNPSDRRRIIQRSRDVLENSSSRSRPLPWRRSFGRPGSVPDSVIFQRKLQWRASIYTKQLRAVRLHSRRLELSLAVNDYTKAKITERIEPWIRRELQAVLGDPDPSVIVHFASALFIKRLERENNRQTGQTGMLVEDEVSSLRKFLSDKVDIFWHELRCFAESILTMETYDAVVEYNEVE

SEQ ID NO: 235 - DNA, 1458 bp, Arabidopsis thaliana
atgagtgattttgatgaaaacttcatcgaaatgacgtcgtattgggctccaccatccagtcctagcccaagaacgatattggcaatgctggagcaaaccgacaatggtctgaatccaatcagtgagatcttccctcaagaaagcttgccaagagatcatactgatcaatctggacaaagatctggtcttcgtgagagactggctgcaagagtaggattcaatcttccaacactcaatacagaagaaaacatgagtcctttggatgcatttttcaggagctcgaatgttcctaattctcctgtcgttgcaatctctccaggattcagtccatcagcactattgcatactcccaatatggtcagtgattcttcccagattatccctccgtcttcagccaccaattacggacctctagagatggtggaaacttccggtgaagacaatgcagcgatgatgatgttcaacaacgatcttccttatcagccgtacaatgttgatctgccttctctagaagtctttgatgatattgcaacggaagagtccttttatatcccatcttatgaacctcatgttgacccaattggaactcctttagtcacatcctttgaatctgaactcgttgacgatgcccataccgacatcatctccattgaggacagtgagagcgaggatggaaacaaagatgatgacgacgaggacttccaatacgaagacgaagacgaagaccaatacgaccaagatcaagatgtagatgaagatgaagaggaagaaaaagatgaagacaatgttgcattagatgatcctcaacctccacctccaaagagaaggagatatgaggtatcaaacatgattggagccacaagaacaagcaagacacaaaggatcatacttcagatggaaagcgacgaagacaatcctaacgatggttatcgctggagaaaatacggtcagaaagtcgtcaaaggaaatcctaatccgaggagttacttcaagtgcacaaacatcgagtgcagagtgaaaaaacatgtggagagaggagcagacaatatcaagttggttgtgactacatacgatgggatacacaaccatccttcaccacctgcacgtagaagcaattccagttcaaggaaccggtctgcaggggcaacaatacctcaaaatcagaatgatcgaaccagtcggttaggtagggctcctcctactcctactcctcctactcctcctccttcgtcttacacacctgaggagatgaggcctttctcttcgttggctacagaaattgatctgacagaggtttatatgaccggaatctctatgctgccgaatataccggtttacgagaattcgggttttatgtaccagaatgatgaaccgacgatgaatgcgatgccggatggttcagatgtgtacgatgggatcatggaacgcctgtattttaagtttggtgtcgacatgtag

SEQ ID NO: 236 - protein, 485 aa, Arabidopsis thaliana
MSDFDENFIEMTSYWAPPSSPSPRTILAMLEQTDNGLNPISEIFPQESLPRDHTDQSGQRSGLRERLAARVGFNLPTLNTEENMSPLDAFFRSSNVPNSPVVAISPGFSPSALLHTPNMVSDSSQIIPPSSATNYGPLEMVETSGEDNAAMMMFNNDLPYQPYNVDLPSLEVFDDIATEESFYIPSYEPHVDPIGTPLVTSFESELVDDAHTDIISIEDSESEDGNKDDDDEDFQYEDEDEDQYDQDQDVDEDEEEEKDEDNVALDDPQPPPPKRRRYEVSNMIGATRTSKTQRIILQMESDEDNPNDGYRWRKYGQKVVKGNPNPRSYFKCTNIECRVKKHVERGADNIKLVVTTYDGIHNHPSPPARRSNSSSRNRSAGATIPQNQNDRTSRLGRAPPTPTPPTPPPSSYTPEEMRPFSSLATEIDLTEVYMTGISMLPNIPVYENSGFMYQNDEPTMNAMPDGSDVYDGIMERLYFKFGVDM

SEQ ID NO: 237 - DNA, 1167 bp, Arabidopsis thaliana
ctgtttttgtatccgtgtaaattaatcacacggtagtttttgatgaaaagacaacaatcggagaacaatctggtctgctgctaaaatttaataaattgttttgtctaattgtctccacccataaaaaagcgcgaattcaattcaccgactaaagacattctccggtggagaccccgatgcaatccactcatataagcggcggaagtagcggtggtggtggtggaggaggaggagaggtgagtcgaagtggattatctcggatccgttcagctccagctacttggattgaaaccctactcgaagaagatgaagaagaaggtttaaaacctaacctttgtttaacagagctgcttactggtaataataactctggaggagtgataacgagtcgtgacgactcgttcgagttcctgagttctgttgagcaaggattgtataatcatcatcaaggtggtggctttcaccgtcagaatagttctccggctgattttcttagtgggtctggttctgggactgatgggtatttctctaattttggtattccggcgaattatgactatttgtcgaccaacgttgatatttctccgactaaacggtctagagatatggaaacacagttttcttctcagctgaaagaagagcaaatgagtggtgggatatcaggaatgatggatatgaacatggacaagatttttgaggattcagttccttgtagggttcgtgctaaacgtggttgtgctactcatcctcgtagcattgctgaacgggtgagaagaacgcgaataagtgatcggattaggaggctgcaagagcttgttcctaacatggataagcaaaccaacactgcagacatgttggaagaagctgtggagtatgtgaaggctcttcaaagccagatccaggaattgacagagcagcagaagagatgcaaatgcaaacctaaagaagaacaataatgtatcctttaggatttgatatatctgtattttatttttgtactatctaaaaatggtgatgatctgttcgaaaattcgaaacatgatcttatatattgaactagaaaaaatagatatatatgaattttagctgtaaaatttttgtacaataaggagaaaaagatttagaagagtcaataaaaagatgatgtttacaagtcaaaaaaaaaaa

SEQ ID NO: 238 - protein, 259 aa, Arabidopsis thaliana
MQSTHISGGSSGGGGGGGGEVSRSGLSRIRSAPATWIETLLEEDEEEGLKPNLCLTELLTGNNNSGGVITSRDDSFEFLSSVEQGLYNHHQGGGFHRQNSSPADFLSGSGSGTDGYFSNFGIPANYDYLSTNVDISPTKRSRDMETQFSSQLKEEQMSGGISGMMDMNMDKIFEDSVPCRVRAKRGCATHPRSIAERVRRTRISDRIRRLQELVPNMDKQTNTADMLEEAVEYVKALQSQIQELTEQQKRCKCKPKEEQ

SEQ ID NO: 239 - DNA, 1290 bp, Arabidopsis thaliana
tcgacaaaaactctcactctccctcaaactaaacaaacatacagaacacaaaatgggtctcacttctcttcaagtttgcatggattctgattggctccaggaatccgagtcatcaggaggaagcatgttagactcttcaacgaattctccgtcagcagccgacatactagcagcttgcagcactagaccacaagcctcggccgtggctgtagccgctgcagctctgatggacggtggaaggaggctgcgtccacctcacgaccatcctcaaaagtgtcctcgttgcgagtcaacacatactaagttctgttactacaataactacagcctctctcagcctcgttacttctgcaagacttgtcgccgttactggacaaaaggcggaactctaaggaatattccggttggtggtggatgccgtaaaaacaagaaaccatcttcctctaattcctcctcctccacttcttccggcaaaaaaccatccaacatcgttaccgccaatacctctgatcttatggctttagcacattctcatcaaaattaccaacattctcctctagggttttcacattttggtgggatgatggggtcttactcaactccggagcatggtaacgttggtttcttggagagcaagtatggcggtttgctttcgcagagccctagacctattgatttcttggacagtaagtttgatctcatgggagtgaacaatgacaacctggtcatggttaatcatggaagtaacggagatcatcatcatcatcataatcatcacatgggtctgaatcacggtgtaggtcttaacaacaacaacaacaatggtggatttaatgggatttctacgggaggcaatggaaatggtggtggtctcatggatatatcgacatgccaaagacttatgctatctaattatgatcatcaccattacaatcatcaagaagatcatcaaagggtagcaacaataatggatgtgaagccaaatccgaagttgttatcgcttgattggcagcaagatcaatgctactccaatggtggtggtagcggaggcgcaggaaaatccgacggtggtggatacggcaatggtggttatatcaacggtttaggttcgtcgtggaatggtttgatgaatggctatggaacgtccactaaaacaaactccttggtttgataagttaatcagaacttcttttttcttgtcgtcatcaactagtagtagtagtaatagtagttggagactagagaagcacttcaaattatttatgggtttgtttgctaagccagttttac

SEQ ID NO: 240 - protein, 372 aa, Arabidopsis thaliana
MGLTSLQVCMDSDWLQESESSGGSMLDSSTNSPSAADILAACSTRPQASAVAVAAAALMDGGRRLRPPHDHPQKCPRCESTHTKFCYYNNYSLSQPRYFCKTCRRYWTKGGTLRNIPVGGGCRKNKKPSSSNSSSSTSSGKKPSNIVTANTSDLMALAHSHQNYQHSPLGFSHFGGMMGSYSTPEHGNVGFLESKYGGLLSQSPRPIDFLDSKFDLMGVNNDNLVMVNHGSNGDHHHHHNHHMGLNHGVGLNNNNNNGGFNGISTGGNGNGGGLMDISTCQRLMLSNYDHHHYNHQEDHQRVATIMDVKPNPKLLSLDWQQDQCYSNGGGSGGAGKSDGGGYGNGGYINGLGSSWNGLMNGYGTSTKTNSLV

SEQ ID NO: 241 - DNA, 923 bp, Arabidopsis thaliana
attccttcttgcctaggaactaattgttgcacacttcggtacacaattttttgagcacttcgacatcaaaacgagagagaaaagaatggtggattctcatggctccgacacggaatgttcctccaagaagaaaaaggagaaaacgaaagaaaagggggtatatcgtggggctcgcatgaggagctgggggaaatgggtctcggagattcgggagccccgtaagaaatcaagaatctggctcgggactttccccacggcggagatggcagcgcgtgcccatgatgttgcggcattgagtatcaaaggaagttccgcaatccttaacttccctgagctcgcggattttctgccaagaccagtctcgctcagccaacaggatatccaggccgcagccgccgaagccgctcttatggatttcaaaactgtaccattccatcttcaggatgactcaacgccgttgcaaactaggtgtgatactgagaagatcgaaaagtggtcatcctcatcgtcctcagcctcatcctcatcctcatcttcgtcctcgtcctcatcatctatgctttcgggggagctaggagatattgtggagttgccgagtcttgaaaacaatgtaaaatacgattgtgcgctgtatgactcgttggaggggctggtgtcgatgcccccatggttagatgctaccgaaaatgattttaggtatggagatgattcggtactgttggacccatgtctcaaagaaagctttttgtggaattatgagtaaggtttttttttggaaagaaatgtggttttttgtttcctcctctcttttatactttcgatctttttttctaagcatatatatcttctacatatgtaatacttttccattagtaaacaatgattcggtttcgggtacaaaaaaaaaaaaaaaaaaaaaaaaa

SEQ ID NO: 242 - protein, 225 aa, Arabidopsis thaliana
MVDSHGSDTECSSKKKKEKTKEKGVYRGARMRSWGKWVSEIREPRKKSRIWLGTFPTAEMAARAHDVAALSIKGSSAILNFPELADFLPRPVSLSQQDIQAAAAEAALMDFKTVPFHLQDDSTPLQTRCDTEKIEKWSSSSSSASSSSSSSSSSSSSMLSGELGDIVELPSLENNVKYDCALYDSLEGLVSMPPWLDATENDFRYGDDSVLLDPCLKESFLWNYE

SEQ ID NO: 243 - DNA, 1368 bp, Arabidopsis thaliana
attcttcttctaaaaaatcttgacaactttttgtttttgttttctttctctgaattttttaaaagagagagagctatgtagctatgaaacagtaagagatatagatatagagagacagagaaagatgatgatcagtgaagttaggctaaacccactttctatttatgtataattaggtcaatcacatcaccaatctcctcctccaattctcctcctctccttccaaattctagggttttgcttgtatctcaccccctttctcaattccctagggaaactgtgaatttcatcaaattccattattttttggtcacacccttaaagagatctgagagttctaaagatgatgacagatttatctctcacgagagatgaagatgaagaagaagcaaagcccttagcagaagaagaaggagcgcgtgaagtagcagacagagagcacatgttcgacaaagttgtgactccaagtgatgtcggaaaactaaaccgacttgtgatcccaaagcaacacgcagagagattcttccctttagattcatcttcaaacgagaaaggtttgcttttaaacttcgaagatctcactggcaaatcttggaggttccgttactcttactggaacagtagtcaaagctatgtcatgactaaaggttggagcagattcgttaaagacaaaaagcttgacgccggagatattgtctctttccaaagatgtgtcggagattcaggaagagatagccgtttgtttattgattggaggagaagacctaaagtccctgaccatcctcatttcgccgccggagctatgttccctaggttttacagctttccttcgaccaattacagtctttataatcatcagcagcaacgtcatcatcacagtggtggtggttataattatcatcaaattccgagagaatttggttatggttacttcgttaggtcagtggatcagaggaacaatcctgcggctgcggtggctgatccgttggtgattgaatctgtgccggtgatgatgcacgggagagctaatcaggaacttgttggaacggccgggaagagactgaggctttttggagttgatatggaatgcggcgagagcggaatgaccaacagtacggaggaggaatcatcatcttccggtggaagtttgccacgtggaggcggtggtggtgcttcatcttcctctttctttcagctgagacttggaagcagcagtgaagatgatcacttcactaagaaaggaaagtcttcattgtcttttgatttggatcaataataatgatgatgatgaaattagttggtattttaagaaaaaaaacatacatatataattctatatatatgacaacataatgcattgatttcctt

SEQ ID NO: 244 - protein, 310 aa, Arabidopsis thaliana
MMTDLSLTRDEDEEEAKPLAEEEGAREVADREHMFDKVVTPSDVGKLNRLVIPKQHAERFFPLDSSSNEKGLLLNFEDLTGKSWRFRYSYWNSSQSYVMTKGWSRFVKDKKLDAGDIVSFQRCVGDSGRDSRLFIDWRRRPKVPDHPHFAAGAMFPRFYSFPSTNYSLYNHQQQRHHHSGGGYNYHQIPREFGYGYFVRSVDQRNNPAAAVADPLVIESVPVMMHGRANQELVGTAGKRLRLFGVDMECGESGMTNSTEEESSSSGGSLPRGGGGGASSSSFFQLRLGSSSEDDHFTKKGKSSLSFDLDQ

SEQ ID NO: 245 - DNA, 1257 bp, Arabidopsis thaliana
cacaaaccacagtctctctttctctctctatctatcttctctttctctctctatctctatcactgaaacccaaagagatccaccatttgttcttttttccttcacacagagaactgttttcttccacacttcctttttactaggcagtgttaaccaattgagagagaaaaatgatggttgatgaaaatgtggaaaccaaggcctctactttagtggcaagtgttgatcatgggtttggatccgggtcgggtcatgatcatcatgggttatcggcgtctgtgcctcttcttggtgttaactggaagaagagaaggatgcctagacagagacgatcttcttcttcctttaaccttctctctttccctcctcctatgcctcctatttcccacgtgccaactcctctccccgcacgtaaaattgacccaagaaagctaagattcctcttccaaaaggaactcaagaacagtgacgtcagctctctccgacgtatgatactcccgaagaaagccgcggaggctcacttgccggcacttgaatgcaaggaagggattcctataagaatggaagatttggacggttttcacgtttggaccttcaagtataggtactggccaaacaacaatagcagaatgtacgtgctagaaaacacaggcgattttgtgaatgctcatggtctgcagctaggtgacttcatcatggtttaccaagatctctactcaaacaattacgttatacaagcaagaaaagcatcggaagaagaagaagtagacgtaatcaatcttgaagaagacgacgtttacacaaacttaacaaggatcgaaaacactgtggttaacgatcttctcctccaagattttaatcatcacaacaacaacaacaacaacaacagcaacagcaacagcaacaaatgttcttactattatccagtcatagatgatgtcaccacaaacacagagtcttttgtctacgacacgacggctcttacctccaacgatactcctctcgattttttgggtggacatacgacgactactaataattattactccaagttcggaacattcgatggtttgggctccgttgagaatatctctctcgatgacttctactagataatcaatcgatgggctcatggtattcttgatggtgatcagctatttaatatccttataatatatataagaattaaatgcaatttgcatatatattatcaagtgttgtaatataacattacagtttaaaaaaaaaaaaaaaaaa

SEQ ID NO: 246 - protein, 312 aa, Arabidopsis thaliana
MVDENVETKASTLVASVDHGFGSGSGHDHHGLSASVPLLGVNWKKRRMPRQRRSSSSFNLLSFPPPMPPISHVPTPLPARKIDPRKLRFLFQKELKNSDVSSLRRMILPKKAAEAHLPALECKEGIPIRMEDLDGFHVWTFKYRYWPNNNSRMYVLENTGDFVNAHGLQLGDFIMVYQDLYSNNYVIQARKASEEEEVDVINLEEDDVYTNLTRIENTVVNDLLLQDFNHHNNNNNNNSNSNSNKCSYYYPVIDDVTTNTESFVYDTTALTSNDTPLDFLGGHTTTTNNYYSKFGTFDGLGSVENISLDDFY

SEQ ID NO: 247 - DNA, 903 bp, Arabidopsis thaliana
ccataataatatattaaaactatatactataatctttttacataataaactttgggtcctgcgtcttaatcatagtacttaattttctctgtgtgttttaatatgaataataaaactgaaatgggatcttccacaagtggaaattgctcgtcggtttcaaccactggtttagctaactccggttcagaatctgatctccggcaacgtgatctaatcgacgagcggaagagaaagaggaaacagtcgaacagagaatctgcgaggaggtcgaggatgaggaagcagaagcatttggatgatctcactgctcaggtgactcatctacgtaaagaaaacgctcagatcgtcgccggaatcgccgtcacgacgcagcactacgtcactatcgaggcggagaacgacattctcagagctcaggttcttgaacttaaccaccgtctccaatctcttaacgagatcgttgatttcgtcgaatcttcttcttcaggattcggtatggagaccggtcagggattattcgacggtggattattcgacggcgtgatgaatcctatgaatctagggttttataatcaaccaatcatggcttctgcttctactgctggtgatgttttcaactgttagaaaacttcacatcattatcatcgtgagtgagactaatcatcgcagcaggggtaaaactgtaatttttcttataaattatgtgatgatgctttgtttctttattttataagatggttaattagtgtttaaaactgattgtaatgatagacagtgtaagaaatgtgtgatatcatggagatggtgatgtgagtttggtacaaatattttaagatcttttctttctatatattaaaagtgaagaaataatattttgtcattttcttaaaaaaaaaaaaaaaa

SEQ ID NO: 248 - protein, 173 aa, Arabidopsis thaliana
MNNKTEMGSSTSGNCSSVSTTGLANSGSESDLRQRDLIDERKRKRKQSNRESARRSRMRKQKHLDDLTAQVTHLRKENAQIVAGIAVTTQHYVTIEAENDILRAQVLELNHRLQSLNEIVDFVESSSSGFGMETGQGLFDGGLFDGVMNPMNLGFYNQPIMASASTAGDVFNC

SEQ ID NO: 249 - DNA, 567 bp, Arabidopsis thaliana
atgattagacatctaaaaccctacatggagtcgtctagtgtccatcgctctcattgtttcgatattcttgatggagtcccactacacgacgatcatttcaactcggcattcctaccaaacactgactttaatgttcatttgcagtcaaacgtatcgacccgcatcaacaatcagtctcacttagacccaaatgcagaaaacattttccataacgaaggtcttgctccagaagaaagaagagcaagaagaatggtctctaaccgggaatctgcaaggaggtcacgtatgcgcaaaaagaagcagatcgaagagctgcaacaacaagttgaacaactcatgatgttgaatcatcacttgtctgagaaagtcatcaacttgttggaaagcaaccatcagatcctacaagagaactcacagctgaaagagaaagtctcttcctttcacttgctcatggcagatgtgctattacccatgagaaatgcagagagcaacatcaatgaccgcaatgtgaattatctaagaggagaaccatcaaaccgtcccaccaacagtccctttggtaagtaa

SEQ ID NO: 250 - protein, 188 aa, Arabidopsis thaliana
MIRHLKPYMESSSVHRSHCFDILDGVPLHDDHFNSAFLPNTDFNVHLQSNVSTRINNQSHLDPNAENIFHNEGLAPEERRARRMVSNRESARRSRMRKKKQIEELQQQVEQLMMLNHHLSEKVINLLESNHQILQENSQLKEKVSSFHLLMADVLLPMRNAESNINDRNVNYLRGEPSNRPTNSPFGK

SEQ ID NO: 251 - DNA, 725 bp, Arabidopsis thaliana
ctaactttcttcccaagtaaacttcaaaatgcagccgcaaacagacgttttcagcctccataactacctaaactcatcgatactgcagtctccgtatccttctaatttcccgatatctacgccatttccaaccaacggtcaaaacccgtacctcctctacggattccaaagccctacaaacaatccacaatccatgagcctaagcagcaacaactcaacatcagatgaagcagaagagcagcagacgaacaacaatataatcaacgagcggaagcagagaaggatgatttcaaaccgagaatccgcaaggagatcgcgtatgaggaagcaaagacaccttgacgagctttggtcacaagtgatgtggttaaggatcgagaatcatcagttgcttgataagcttaacaatctctctgagtctcacgacaaggttcttcaagagaatgctcagcttaaagaagaaacatttgagcttaagcaagtgatcagcgatatgcaaattcaaagccctttctcttgctttagagacgatataatccccattgaataaagcatttttccccgattcatatttatgaaaattttcttcaagagtatgtttctttgtatgtatatgtggagatgtatttcagggttttgataatatgaccctttacgacgacgtttttagattgtagtaaatttataaactaaagaagattagtgttaatgaagaacaaatataa

SEQ ID NO: 252 - protein, 173 aa, Arabidopsis thaliana
MQPQTDVFSLHNYLNSSILQSPYPSNFPISTPFPTNGQNPYLLYGFQSPTNNPQSMSLSSNNSTSDEAEEQQTNNNIINERKQRRMISNRESARRSRMRKQRHLDELWSQVMWLRIENHQLLDKLNNLSESHDKVLQENAQLKEETFELKQVISDMQIQSPFSCFRDDIIPIE

SEQ ID NO: 253 - DNA, 1116 bp, Arabidopsis thaliana
ttggaaccctagaggcctttcaagcaaatcatcagggtaacaatttcttgatctttctttttagcgaatttccagtttttggtcaatcatggcaaacccttggtggacgaaccagagtggtttagcgggcatggtggaccattcggtctcctcaggccatcaccaaaaccatcaccaccaaagtcttcttaccaaaggagatcttggaatagccatgaatcagagccaagacaacgaccaagacgaagaagatgatcctagagaaggagccgttgaggtggtcaaccgtagaccaagaggtagaccaccaggatccaaaaacaaacccaaagctccaatctttgtgacaagagacagccccaacgcactccgtagccatgtcttggagatctccgacggcagtgacgtcgccgacacaatcgctcacttctcaagacgcaggcaacgcggcgtttgcgttctcagcgggacaggctcagtcgctaacgtcaccctccgccaagccgccgcaccaggaggtgtggtctctctccaaggcaggtttgaaatcttatctttaaccggtgctttcctccctggaccttccccacccgggtcaaccggtttaacggtttacttagccggggtccagggtcaggtcgttggaggtagcgttgtaggcccactcttagccatagggtcggtcatggtgattgctgctactttctctaacgctacttatgagagattgcccatggaagaagaggaagacggtggcggctcaagacagattcacggaggcggtgactcaccgcccagaatcggtagtaacctgcctgatctatcagggatggccgggccaggctacaatatgccgccgcatctgattccaaatggggctggtcagctagggcacgaaccatatacatgggtccacgcaagaccaccttactgactcagtgagccatttctatatataatggtctatataaataaatatatagatgaatataagcaagcaatttgaggtagtctattacaaagcttttgctctggttggaaaaataaataagtatcaaagctttgtttgttcttaatggaaatatagagcttgggaaggtagaaagagacgacatt

SEQ ID NO: 254 - protein, 281 aa, Arabidopsis thaliana
MANPWWTNQSGLAGMVDHSVSSGHHQNHHHQSLLTKGDLGIAMNQSQDNDQDEEDDPREGAVEVVNRRPRGRPPGSKNKPKAPIFVTRDSPNALRSHVLEISDGSDVADTIAHFSRRRQRGVCVLSGTGSVANVTLRQAAAPGGVVSLQGRFEILSLTGAFLPGPSPPGSTGLTVYLAGVQGQVVGGSVVGPLLAIGSVMVIAATFSNATYERLPMEEEEDGGGSRQIHGGGDSPPRIGSNLPDLSGMAGPGYNMPPHLIPNGAGQLGHEPYTWVHARPPY

SEQ ID NO: 255 - DNA, 1295 bp, Arabidopsis thaliana
tcgaccagcttggatttcgttgttcatcattactactctctttcttcttctagctagctagttttgacagcaaaataagaagcaaaaaaaaggtcaactaaaaaagatctgttcttagatcactctcttcttctttttttgatccaattccaccattgaatcatagatcatggatccagtacaatctcatggatcacaaagctctctacctcctcctttccacgcaagagactttcaattacatcttcaacaacagcaacaagagttcttcctccaccatcaccagcaacaaagaaaccaaaccgatggtgaccaacaaggaggatcaggaggaaaccgacaaatcaagatggatcgtgaagagacaagcgacaacatagacaacatagctaacaacagcggtagtgaaggtaaagacatagatatacacggtggttcaggagaaggaggtggtggctccggaggagatcatcagatgacaagaagaccaagaggaagaccagcgggatccaagaacaaaccaaaaccaccgattatcatcacacgggacagcgcaaacgcgcttagaacccacgtgatggagatcggagatggctgcgacttagtcgaaagcgttgccacttttgcacgaagacgccaacgcggcgtttgcgttatgagcggtactggaaatgttactaacgtcactatacgtcagcctggatctcatccttctcctggctcggtagttagtcttcacggaaggttcgagattctatctctctcaggatcttttctccctcctccggctcctcctacagccaccggattgagtgtttacctcgctggaggacaaggacaggtggttggaggaagcgtagttggtccgttgttatgtgctggtcctgtcgttgtcatggctgcgtcttttagcaatgcggcgtacgaaaggttgcctttagaggaagatgagatgcagacgccggttcatggcggaggaggaggaggatcattggagtcgccgccaatgatgggacaacaactgcaacatcagcaacaagctatgtcaggtcatcaagggttaccacctaatcttcttggttcggttcagttgcagcagcaacatgatcagtcttattggtcaacgggacgaccaccgtattgatcaaatatacacacacactcataatcgttgctagctagctaacgatgaatcatgagtttagtggatatatatatgattaaaagaggttagcttatgaacattaataagagtttggattctatcgagcttcattatgtttgggtcatcgttc

SEQ ID NO: 256 - protein, 324 aa, Arabidopsis thaliana
MDPVQSHGSQSSLPPPFHARDFQLHLQQQQQEFFLHHHQQQRNQTDGDQQGGSGGNRQIKMDREETSDNIDNIANNSGSEGKDIDIHGGSGEGGGGSGGDHQMTRRPRGRPAGSKNKPKPPIIITRDSANALRTHVMEIGDGCDLVESVATFARRRQRGVCVMSGTGNVTNVTIRQPGSHPSPGSVVSLHGRFEILSLSGSFLPPPAPPTATGLSVYLAGGQGQVVGGSVVGPLLCAGPVVVMAASFSNAAYERLPLEEDEMQTPVHGGGGGGSLESPPMMGQQLQHQQQAMSGHQGLPPNLLGSVQLQQQHDQSYWSTGRPPY

SEQ ID NO: 257 - DNA, 1342 bp, Arabidopsis thaliana
attttagtcttcctataacttcttctcaatcctctctcatatcttttttcttagtttaaatttcaataaaatagaaaaaaacatatacaaatctacagagaagagaagctttattttaatcttgtgtgtgtgtgtgtgttttatataatttttattttttttcaaattaaaatctcttctttgcttttgatgtgggcatggctggtcttgatctaggcacagcttttcgttacgttaatcaccagctccatcgtcccgatctccaccttcaccacaattcctcctccgatgacgtcactcccggagccgggatgggtcatttcaccgtcgacgacgaagacaacaacaacaaccatcaaggtcttgacttagcctctggtggaggatcaggaagctctggaggaggaggaggtcacggcgggggaggagacgtcgttggtcgtcgtccacgtggcagaccaccgggatccaagaacaaaccgaaacctccggtaattatcacgcgcgagagcgcaaacactctaagagctcacattcttgaagtaacaaacggctgcgatgttttcgactgcgttgcgacttatgctcgtcggagacagcgagggatctgcgttctgagcggtagcggaacggtcacgaacgtcagcatacgtcagccatctgcggctggagcggttgtgacgctacaaggaacgttcgagattctttctctctccggatcgtttcttcctcctccggcacctcccggagcaacgagtttgacaattttcttagccggaggacaaggtcaggtggttggaggaagcgttgtgggtgagcttacggcggctggaccggtgattgtgattgcagcttcgtttactaatgttgcttatgagagacttcctttagaagaagatgagcagcagcaacagcttggaggaggatctaacggcggaggtaatttgtttccggaggtggcagctggaggaggaggaggacttccgttctttaatttaccgatgaatatgcaaccaaatgtgcaacttccggtggaaggttggccggggaattccggtggaagaggtcctttctgatgtgtatatattgataatcattatatatataccggcggagaagcttttccggcgaagaatttgcgagagtgaagaaaggttagaaaagcttttaatggactaatgaatttcaaattatcatcgtgatttcggacattgtcttgttcatcatgttaagcttaggtttattttttgtcgtttgtagaattttatgtttgaatccttttttttttctgtgaaactctattgtgttcgtctgcgaaggaaaaaaaaattctcaaaaaaaa

SEQ ID NO: 258 - protein, 292 aa, Arabidopsis thaliana
MAGLDLGTAFRYVNHQLHRPDLHLHHNSSSDDVTPGAGMGHFTVDDEDNNNNHQGLDLASGGGSGSSGGGGGHGGGGDVVGRRPRGRPPGSKNKPKPPVIITRESANTLRAHILEVTNGCDVFDCVATYARRRQRGICVLSGSGTVTNVSIRQPSAAGAVVTLQGTFEILSLSGSFLPPPAPPGATSLTIFLAGGQGQVVGGSVVGELTAAGPVIVIAASFTNVAYERLPLEEDEQQQQLGGGSNGGGNLFPEVAAGGGGGLPFFNLPMNMQPNVQLPVEGWPGNSGGRGPF

SEQ ID NO: 259 - DNA, 2663 bp, Arabidopsis thaliana
aagtaagagagcttcttaaggaagaagaagatgggttgtgctcaatcaaagatcgagaacgaagaagcagttactcgttgcaaagaacgaaaacaattgatgaaagacgccgtcactgctcgtaacgctttcgccgccgctcactcagcttacgctatggctcttaaaaacaccggagctgctctttccgattactctcacggcgagtttttagtctctaatcactcgtcttcctccgcagctgcagcaatcgcttctacttcttctcttcccactgctatatctcctcctcttccttcttccaccgctccggtttctaattcaaccgcttcttcttcctccgctgcggttcctcagccgattcctgatactcttcctcctcctcctcctccaccaccgcttcctcttcaacgtgctgctactatgccggagatgaacggtagatccggtggtggtcatgctggtagtggactcaacggaattgaagaagatggagccctagataacgatgatgatgacgatgatgatgatgatgactctgaaatggagaatcgtgatcgtttgattaggaaatcgagaagccgtggaggtagtactagaggaaataggacgacgattgaagatcatcatcttcaggaggagaaagctccgccacctccccctttggcgaattcgcggccaattccgccgccacgtcagcatcagcatcaacatcagcaacagcaacaacaacctttctacgattacttcttccctaatgttgagaatatgcctggaactactttagaagatactcctccacaaccacaaccacaaccaacaaggcctgtgcctcctcaaccacattcaccagtcgttactgaggatgacgaagatgaggaggaggaagaggaggaagaggaggaggaagaggagacggtgattgaacggaaaccactggtggaggaaagaccgaagagagtagaggaagtgacgattgaattggaaaaagttactaatttgagagggatgaagaagagtaaagggatagggattcccggagagaggagaggaatgcgaatgccggtgactgcgacgcatttggcgaatgtattcattgagcttgatgataatttcttgaaagcttctgaaagtgctcatgatgtttctaagatgcttgaagctactaggctccattaccattctaattttgcagataaccgaggacatattgatcactctgctagagtgatgcgtgtaattacatggaatagatcatttagaggaataccaaatgctgatgatgggaaagatgatgttgatttggaagagaatgaaactcatgctactgttcttgacaaattgctagcatgggaaaagaagctctatgacgaagtcaaggctggcgaactcatgaaaatcgagtaccagaaaaaggttgctcatttaaatcgggtgaagaaacgaggtggccactcggattcattagagagagctaaagcagcagtaagtcatttgcatacaagatatatagttgatatgcaatccatggactccacagtttcagaaatcaatcgtcttagggatgaacaactatacctaaagctcgttcaccttgttgaggcgatggggaagatgtgggaaatgatgcaaatacatcatcaaagacaagctgagatctcaaaggtgttgagatctctagatgtttcacaagcggtgaaagaaacaaatgatcatcatcacgaacgcaccatccagctcttggcagtggttcaagaatggcacacgcagttttgcaggatgatagatcatcagaaagaatacataaaagcacttggcggatggctaaagctaaatctcatccctatcgaaagcacactcaaggagaaagtatcttcgcctcctcgagttcccaatcccgcaatccaaaaactcctccacgcttggtatgaccgtttagacaaaatccccgacgaaatggctaaaagtgccataatcaatttcgcagcggttgtaagcacgataatgcagcagcaagaagacgagataagtctcagaaacaaatgcgaagagacaagaaaagaattgggaagaaaaattagacagtttgaggattggtaccacaaatacatccagaagagaggaccggaggggatgaatccggatgaagcggataacgatcataatgatgaggtcgctgtgaggcaattcaatgtagaacaaattaagaagaggttggaagaagaagaagaagcttaccatagacaaagccatcaagttagagagaagtcactggctagtcttcgaactcgcctccccgagctttttcaggcaatgtccgaggttgcgtattcatgttcggatatgtatagagctataacgtatgcgagtaagcggcaaagccaaagcgaacggcatcagaaacctagccagggacagagttcgtaagaactaatgtaagatcagagtaatgtcttcttcttctttgatcttgaatatttaagcacacacatacatacaacgtatagctaaatctttatcattgctttcttatattaaggttttggcttttgtaagaaggtttcttacatatgagattcatatagtgtttgattcttaaggaactgttctgttgagtaataagaaagttgtgtattgaaatagagttgcatttgttaattttg

SEQ ID NO: 260 - protein, 798 aa, Arabidopsis thaliana
MGCAQSKIENEEAVTRCKERKQLMKDAVTARNAFAAAHSAYAMALKNTGAALSDYSHGEFLVSNHSSSSAAAAIASTSSLPTAISPPLPSSTAPVSNSTASSSSAAVPQPIPDTLPPPPPPPPLPLQRAATMPEMNGRSGGGHAGSGLNGIEEDGALDNDDDDDDDDDDSEMENRDRLIRKSRSRGGSTRGNRTTIEDHHLQEEKAPPPPPLANSRPIPPPRQHQHQHQQQQQQPFYDYFFPNVENMPGTTLEDTPPQPQPQPTRPVPPQPHSPVVTEDDEDEEEEEEEEEEEEETVIERKPLVEERPKRVEEVTIELEKVTNLRGMKKSKGIGIPGERRGMRMPVTATHLANVFIELDDNFLKASESAHDVSKMLEATRLHYHSNFADNRGHIDHSARVMRVITWNRSFRGIPNADDGKDDVDLEENETHATVLDKLLAWEKKLYDEVKAGELMKIEYQKKVAHLNRVKKRGGHSDSLERAKAAVSHLHTRYIVDMQSMDSTVSEINRLRDEQLYLKLVHLVEAMGKMWEMMQIHHQRQAEISKVLRSLDVSQAVKETNDHHHERTIQLLAVVQEWHTQFCRMIDHQKEYIKALGGWLKLNLIPIESTLKEKVSSPPRVPNPAIQKLLHAWYDRLDKIPDEMAKSAIINFAAVVSTIMQQQEDEISLRNKCEETRKELGRKIRQFEDWYHKYIQKRGPEGMNPDEADNDHNDEVAVRQFNVEQIKKRLEEEEEAYHRQSHQVREKSLASLRTRLPELFQAMSEVAYSCSDMYRAITYASKRQSQSERHQKPSQGQSS

SEQ ID NO: 261 - DNA, 531 bp, Arabidopsis thaliana
atgggttatccggtggggtacactgagctcctcctcccaagaatcttccttcacttactctctctcttaggcttaatacgaacactcatagacacgggttttcggatattgggtctacccgactttctcgaatccgacccggtttcatcgtcatcgtcatggctggaaccaccgtatatgtccacggcggcgcatcatcaccaagaaagctcatttttcttcccagtggcggcgaggctagctggagaaatcttgcccgtcatcagattctcggagctaactcgacccggattcggatccggatccgattgctgcgcggtgtgcctccacgagttcgagaacgatgacgagatccgacggctgacgaattgtcaacacatatttcaccggagctgtttagaccgttggatgatgggttataatcagatgacgtgtccactttgtagaacgccgtttatttctgatgagttacaagttgcttttaaccaacgagtttggtctgaatctgaacttctcgcagaatcaaattag

SEQ ID NO: 262 - protein, 176 aa, Arabidopsis thaliana
MGYPVGYTELLLPRIFLHLLSLLGLIRTLIDTGFRILGLPDFLESDPVSSSSSWLEPPYMSTAAHHHQESSFFFPVAARLAGEILPVIRFSELTRPGFGSGSDCCAVCLHEFENDDEIRRLTNCQHIFHRSCLDRWMMGYNQMTCPLCRTPFISDELQVAFNQRVWSESELLAESN

SEQ ID NO: 263 - DNA, 1407 bp, Arabidopsis thaliana
gacagactctctctgtatgtgtgcgagaagcgagaagcgagagagagagagagagagttgttagctcacacgctttctctattttctcggaattcacaaaacagaaagtttcatcctttacgagaattaagccgaaagaaacaatctttgagtttgatttcttcttccttccttctctctctctgctctaatggattccagagacatcccaccgtcacataaccagcttcaaccaccaccgggaatgttaatgtctcattaccgtaaccctaacgccgccgcttcaccattaatggttcccacttccacatctcaaccgattcaacaccctcgtcttccttttggcaatcaacaacaatctcaaacgtttcatcagcagcaacaacaacaaatggatcagaagactcttgaatctcttggatttggtgatggatcaccttcttctcaaccgatgcgattcgggatcgatgatcagaatcagcaactgcaagtgaagaagaagcgaggaaggccgagaaagtatactcctgatggtagcattgctttaggtttagctcctacgtctcctcttctctctgcagcttctaattcttacggtgagggtggtgttggagatagtggtggaaatggaaactctgttgatccacctgttaaacgtaacagaggaaggcctcctggttctagtaagaaacagcttgatgctttaggaggaacttcaggagttgggtttacacctcatgtcattgaagtgaacacaggagaggacatagcgtcaaaggtgatggctttttcggatcaagggtcaagaacaatttgtattctctctgcaagtggtgcagtttctagagtgatgcttcgtcaagcttctcattctagtggaatcgttacttatgagggacgatttgagatcattactctctcaggctcagtcttgaattatgaggtaaatggttccaccaacagaagtggtaacttgagtgtggctttggctggacctgatggcggcatcgtaggtggcagtgtagttggtaatctagtagctgcaacacaagtccaggtgatagtgggaagctttgttgcagaagcaaagaaaccgaaacaaagtagtgttaacattgctcgggggcagaatcctgaaccggcttcagcgccggctaacatgttgaactttggatcagtctctcaaggaccatcgagcgagtcatcagaagagaatgagagcggttctcctgcaatgcaccgtgacaataataatgggatatatggagctcaacaacaacaacaacaacaacctcttcatcctcatcagatgcaaatgtaccaacatctttggtctaatcatggtcaataaaatgaagcggaaattaatttgtttccgttttggttacggttatggtttgatttctt

SEQ ID NO: 264 - protein, 386 aa, Arabidopsis thaliana
MDSRDIPPSHNQLQPPPGMLMSHYRNPNAAASPLMVPTSTSQPIQHPRLPFGNQQQSQTFHQQQQQQMDQKTLESLGFGDGSPSSQPMRFGIDDQNQQLQVKKKRGRPRKYTPDGSIALGLAPTSPLLSAASNSYGEGGVGDSGGNGNSVDPPVKRNRGRPPGSSKKQLDALGGTSGVGFTPHVIEVNTGEDIASKVMAFSDQGSRTICILSASGAVSRVMLRQASHSSGIVTYEGRFEIITLSGSVLNYEVNGSTNRSGNLSVALAGPDGGIVGGSVVGNLVAATQVQVIVGSFVAEAKKPKQSSVNIARGQNPEPASAPANMLNFGSVSQGPSSESSEENESGSPAMHRDNNNGIYGAQQQQQQQPLHPHQMQMYQHLWSNHGQ

SEQ ID NO: 265 - DNA, 1150 bp, Arabidopsis thaliana
tcgactcctctcctgattgcttcaccttcttctttactacaggtttcagctcctcaatgtccatggattgcttaagctacttctttaactacgatcctcctgtccagctccaggattgctttattcccgagatggatatgattatccctgaaaccgatagtttcttcttccaatctcaaccgcaactggagtttcatcagccattgtttcaagaagaagctccttcacagacccactttgaccctttctgcgaccagtttctttctccgcaagaaatctttctccctaaccctaaaaacgaaatcttcaacgaaacacacgacctcgatttctttctccccacgccaaaacgccagagacttgttaactccagctacaattgtaacactcaaaaccatttccagagccgtaacccgaatttcttcgaccctttcggcgacactgatttcgttccagaatcttgtaccttccaggagtttcgagttccggatttctctttagctttcaaggtaggccggggagatcaagatgactcaaagaaaccgacgctttcatctcagagcatcgcggctagagggaggagaagaagaattgcagagaagactcacgagctcggaaaactcatccccggtggcaataaacttaacaccgccgagatgttccaagccgccgctaagtatgtcaagtttttgcagagtcaagttgggattctccaactgatgcagaccacaaagaaggtaataaccaaccccaaataagaactttatcatccaattgaaactctaatcgtgttttctcacaagcttcttaatttgtttacgcagggtagctctaatgtgcaaatggaaactcagtatttgcttgaatcgcaagcaatccaggagaagttatcaacagaggaagtgtgtttggtaccgtgtgaaatggttcaagatctaacaactgaagaaaccatttgcagaaccccgaatatttctcgagaaatcaacaagttactgtctaaacatctggctaactagttttagtttcaagcctgaagttctctatgcctaaatttgtgtctgttatcgttgttttgtcttcttagttagtgttttgtcttgttgatttaggggctaattatcctggttaatctcctcttaactgggaa

SEQ ID NO: 266 - protein, 233 aa, Arabidopsis thaliana
MSMDCLSYFFNYDPPVQLQDCFIPEMDMIIPETDSFFFQSQPQLEFHQPLFQEEAPSQTHFDPFCDQFLSPQEIFLPNPKNEIFNETHDLDFFLPTPKRQRLVNSSYNCNTQNHFQSRNPNFFDPFGDTDFVPESCTFQEFRVPDFSLAFKVGRGDQDDSKKPTLSSQSIAARGRRRRIAEKTHELGKLIPGGNKLNTAEMFQAAAKYVKFLQSQVGILQLMQTTKKVITNPK

SEQ ID NO: 267 - DNA, 1357 bp, Arabidopsis thaliana
gtgatttctctctgccatttccttcgatttgatttctgggttctcttcttctcgtctctcttctgcatgtttcgccactctaccttagaaaaaaggttactttcgcctccgatttaggctcgatttgatgaattcgtcgtcgtgtggctatttatcaaattgagcattagggtttctgatttgtgggttcagaattgtttttatctatctgtcttgttgttttttgtccgctacaaaagcctatggattctcagaggggtattgttgaacaagctaaatctcagtccttgaataggcaaagctctctttacagcttaacacttgatgaggttcaaaatcacttggggagttctggtaaagctctgggaagcatgaaccttgatgagcttttgaagagtgtctgttctgttgaagctaatcagccatcgtctatggctgtcaatggtggagcagctgctcaggagggtctttctcgccaggggagtttgactttgcctcgggatctcagcaaaaagactgttgatgaggtttggaaagacattcagcagaataagaatggaggtagtgctcatgagaggagggataagcagcctacacttggggaaatgacgcttgaagacctgttgttgaaagcaggagtggtcactgagactatccctggttcgaaccatgatggtcctgttggtggtggtagtgctggttcaggtgctggtttagggcaaaacattactcaagttggcccatggattcaatatcatcagctcccatcaatgccacagcctcaagcatttatgccctatccggtttcagatatgcaagcaatggtgtctcagtcttctttgatgggtggtttgtcagatacacaaactcctggaaggaagagggtagcttcaggagaagttgtagagaagactgtagagaggaggcagaagagaatgataaagaacagagagtctgctgctcgttcccgagctaggaaacaggcttacactcatgagctagagatcaaagtttcacggttagaagaagaaaacgaaagactcaggaagcaaaaggaggtggaaaaatcctcccaagtgtaccaccgcctgatcccaagcggcagctccgacggacaagctcggctcctttctgatctctaaactctttttgtctttttctttttttctcttctgtgtcggttcacttataaaaaagagaggaaaacagctttgtttctttgtacattccgtagactttcttgacttggagcaattctgttaactttaaaatattctcgagttattgtagtagcagactagcagcagtaatggttttcatgagtccgattgaaattcagagattgaacaggaaaaaa

SEQ ID NO: 268 - protein, 299 aa, Arabidopsis thaliana
MDSQRGIVEQAKSQSLNRQSSLYSLTLDEVQNHLGSSGKALGSMNLDELLKSVCSVEANQPSSMAVNGGAAAQEGLSRQGSLTLPRDLSKKTVDEVWKDIQQNKNGGSAHERRDKQPTLGEMTLEDLLLKAGVVTETIPGSNHDGPVGGGSAGSGAGLGQNITQVGPWIQYHQLPSMPQPQAFMPYPVSDMQAMVSQSSLMGGLSDTQTPGRKRVASGEVVEKTVERRQKRMIKNRESAARSRARKQAYTHELEIKVSRLEEENERLRKQKEVEKSSQVYHRLIPSGSSDGQARLLSDL

SEQ ID NO: 269 - DNA, 1604 bp, Arabidopsis thaliana
tttgggcgggtctttctttccctaaatctttcttttattttgctgtttaaaaaaaaaatccaaccataagacaaaacaacgaacgaggaagagagagagagaaggatatatctctaatcacgatgcaggagataataccggattttcttgaagagtgtgaatttgtcgacacttcactagccggagatgatctatttgccatcttagagagtcttgaaggtgccggagagatatctccgacagctgcatctacacctaaagatggaaccacaagttccaaggagttagttaaggatcaagattatgaaaactcatctcctaagaggaaaaagcaaagactagaaaccaggaaagaagaggacgaagaagaagaagacggagacggagaagcagaagaagataataagcaagatgggcaacaaaagatgtctcatgtaaccgtggaacgtaaccggagaaagcaaatgaacgagcacttaaccgttttgcgttctcttatgccttgtttctacgtcaaacggggggaccaagcatcgatcataggaggagttgtggagtacataagcgagttacaacaagttctccaatctttggaagccaagaaacaacgtaaaacctacgccgaagtcctaagcccgagagttgtcccgagccctcgtccttcaccgcctgttctaagcccaagaaaaccgcctcttagcccgcgcatcaaccaccaccagattcaccaccacctacttctccctcccataagtcctcgaacacctcagccaacaagcccataccgggccattccaccgcaactaccactcatcccacagcctccgcttcgctcttacagctcattggccagttgcagcagcttaggagatccacctccatactctcctgcttcatcttcttcatctccttcagttagtagtaaccatgagagtagtgtgatcaatgagcttgttgctaactcaaaatcggctttggctgatgtggaagtgaagttttcaggagctaacgtgctgctcaaaacggtgtcgcataagatcccgggacaagttatgaagataattgctgctcttgaagatttggctcttgagattcttcaggttaatattaacaccgtcgacgaaaccatgcttaattctttcaccatcaagattggaattgagtgccaactaagtgcagaagaactggctcaacaaattcagcaaacattctgctagtaaagaaggatttaatatagcttcgtataaaccttaacgagagagcagtacgtactcactttctctccttagtatccctttaattatcttttcagttttctgcaaagatatggagtttaaaaaaataaaattgttatctaaagttttaatcaaatattgattaattataactaatataggtataagtgagttttaaagattatcagcttcataacagccatcgtcatgtttactttcttttaaattttagaatttagacgtactcctaccatgtaattttatttctgtcattacatcaagcattgtagctgtaattgcatatgaatgaacaatagtgtatgagtgatctcatgaataatattcttcttgcaacacaaaaaaaaaaaa

SEQ ID NO: 270 - protein, 364 aa, Arabidopsis thaliana
MQEIIPDFLEECEFVDTSLAGDDLFAILESLEGAGEISPTAASTPKDGTTSSKELVKDQDYENSSPKRKKQRLETRKEEDEEEEDGDGEAEEDNKQDGQQKMSHVTVERNRRKQMNEHLTVLRSLMPCFYVKRGDQASIIGGVVEYISELQQVLQSLEAKKQRKTYAEVLSPRVVPSPRPSPPVLSPRKPPLSPRINHHQIHHHLLLPPISPRTPQPTSPYRAIPPQLPLIPQPPLRSYSSLASCSSLGDPPPYSPASSSSSPSVSSNHESSVINELVANSKSALADVEVKFSGANVLLKTVSHKIPGQVMKIIAALEDLALEILQVNINTVDETMLNSFTIKIGIECQLSAEELAQQIQQTFC

SEQ ID NO: 271 - DNA, 1746 bp, Arabidopsis thaliana
atgatcatgtacggaggaggaggagcagggaaggacggtggatccaccaatcacttatcagacggaggagtgatattgaagaaaggtccatggacggcggcggaagatgagatacttgctgcgtacgttagagagaacggtgaagggaattggaacgccgttcagaaaaacacaggtttggctcgttgcggcaaaagctgccgtcttcgatgggccaatcacctccgaccaaatctgaaaaaaggctctttcaccggtgacgaagaacgtctcatcattcagcttcatgctcagcttggtaacaaatgggctcgcatggctgctcagttaccgggaagaacagacaacgagattaagaactattggaacacgagattgaaacgacttcttcgccaaggacttcctctttatcctccagatattatccctaaccatcaactccatccacatccacatcatcaacaacaacagcaacataaccatcatcatcatcatcatcaacaacaacaacaacatcaacaaatgtattttcaaccacaatcttcacaacgaaacacaccatcatcttcccctcttccatctccaacaccagcaaacgcaaagtcctcatcatccttcacttttcataccacgactgctaacctcctccatccacttagccctcacactccaaacacaccatctcaactctcttccacaccgcctccaccaccactttcctctcctttatgttcccctcgcaacaaccaatacccgacccttcccctctttgccctcccgcgttcccaaatcaacaacaacaacaacggaaatttcactttccctagacctccacctctccttcaaccgccttcatcactcttcgcaaaacgttacaacaatgctaacactcctcttaattgcatcaaccgcgtctcaaccgcaccattttcccctgtttcaagagactcctacacttcctttcttacattgccttacccttccccaaccgctcaaaccgctacttaccacaatactaataacccttactcttcctctccttccttctctttaaacccttcttcttcttcttaccctacatcaacttcttccccaagctttcttcactcccattacactccttcttccacctcatttcataccaacccagtttactccatgaaacaagagcagctcccttcaaaccaaattccccaaatagatggcttcaataacgtcaacaacttcacagacaacgagagacagaatcataaccttaacagttccggtgctcatagaagaagtagtagctgcagcctcttagaggatgtcttcgaagaggccgaagctttagcctctggaggcagaggccgacctccaaaacgaagacaactcacagcttctcttccgaaccacaacaacaacaccaacaacaacgacaacttcttctcggttagtttcggacattatgattcttctgacaacttatgttccttgcaagatttgaaatcaaaggaagaagagtctcttcaaatgaacacaatgcaggaggacatagctaagcttcttgattggggaagtgatagtggagagatctctaatggacaatcatctgttgtcactgacgacaatcttgttcttgatgttcatcaattagcttcactattcccggctgattctacagccgtcgtagccgcaacaaacgaccaacacaacaagaataataacaataattgttcctgggatgacatgcagggaataaggtag

SEQ ID NO: 272 - protein, 581 aa, Arabidopsis thaliana
MIMYGGGGAGKDGGSTNHLSDGGVILKKGPWTAAEDEILAAYVRENGEGNWNAVQKNTGLARCGKSCRLRWANHLRPNLKKGSFTGDEERLIIQLHAQLGNKWARMAAQLPGRTDNEIKNYWNTRLKRLLRQGLPLYPPDIIPNHQLHPHPHHQQQQQHNHHHHHHQQQQQHQQMYFQPQSSQRNTPSSSPLPSPTPANAKSSSSFTFHTTTANLLHPLSPHTPNTPSQLSSTPPPPPLSSPLCSPRNNQYPTLPLFALPRSQINNNNNGNFTFPRPPPLLQPPSSLFAKRYNNANTPLNCINRVSTAPFSPVSRDSYTSFLTLPYPSPTAQTATYHNTNNPYSSSPSFSLNPSSSSYPTSTSSPSFLHSHYTPSSTSFHTNPVYSMKQEQLPSNQIPQIDGFNNVNNFTDNERQNHNLNSSGAHRRSSSCSLLEDVFEEAEALASGGRGRPPKRRQLTASLPNHNNNTNNNDNFFSVSFGHYDSSDNLCSLQDLKSKEEESLQMNTMQEDIAKLLDWGSDSGEISNGQSSVVTDDNLVLDVHQLASLFPADSTAVVAATNDQHNKNNNNNCSWDDMQGIR

SEQ ID NO: 273 - DNA, 1538 bp, Arabidopsis thaliana
cagctcaaactctctaggactacactaaatctaactttttgcagagagcaaaagattcaataattgagattgatctcaaaaccaaagctctcgtgctcttgtcgttgatgttggttgtgtagactttgtatacaatgatgaaaagtttggcgaatgctgttggagcgaagacggcgagggcttgcgacagctgcgtgaagagacgtgcacggtggtactgcgcggccgacgatgcttttctttgccagtcttgcgacagtttggtccattcagcaaaccctcttgctcgccgccacgagagagtccgtttgaagacggctagcccggcggtcgtaaagcatagcaaccactcatcagcttctcctccacatgaggtcgccacgtggcatcacgggtttactcgtaaagctcgaacgccacgtggctctggtaagaaaaacaattcgtcgatatttcatgacttggttcctgatattagtattgaggatcagacagacaactatgagcttgaagagcagctgatctgtcaagtgccggttctagatccgttggtgtctgagcagttcttgaacgatgtcgttgagcccaagatcgagtttcctatgatcagaagtggtttgatgatcgaggaggaggaagacaacgctgaaagttgtcttaatggatttttcccgaccgacatggagcttgaggagtttgctgctgacgtggagactctgctcggtcgcgggttagacacggagtcgtatgccatggaggagctagggttatctaattcagagatgttcaaaatcgaaaaagatgagattgaagaagaagtagaagagataaaagccatgagcatggatatatttgatgatgatcgaaaagacgtggatggaacagtaccgtttgagctaagctttgattacgagtcgtcacacaagacgtccgaagaagaggtaatgaagaacgttgaaagtagtggtgaatgtgttgttaaggtgaaagaggaagaacataagaatgttctgatgctaagattaaactatgactcggtgatatccacttggggaggtcaaggtccaccgtggagttcaggagagccaccggaacgagacatggacatcagcggttggccagccttttccatggtggagaatggaggagaaagtactcatcagaagcaatacgttggtggatgtttaccatcaagtgggtttggagatggaggtagagaagctagagtttcgagatacagagagaagaggaggacaaggttgttttctaagaagatacggtacgaggtacgtaaattgaatgcagagaaaagaccacgaatgaaaggaagattcgtgaagagagcctcgctcgctgctgctgcttcaccattaggtgttaattactgaatagttaatatctattcatgttatatctcactttacaaatttcggtgaatcttttttcttctgaaacaacagaagttattttggcacttaattgtgctttgaggacttgtatgtacatagaagtaaccaataataatgtgacttttacta

SEQ ID NO: 274 - protein, 416 aa, Arabidopsis thaliana
MKSLANAVGAKTARACDSCVKRRARWYCAADDAFLCQSCDSLVHSANPLARRHERVRLKTASPAVVKHSNHSSASPPHEVATWHHGFTRKARTPRGSGKKNNSSIFHDLVPDISIEDQTDNYELEEQLICQVPVLDPLVSEQFLNDVVEPKIEFPMIRSGLMIEEEEDNAESCLNGFFPTDMELEEFAADVETLLGRGLDTESYAMEELGLSNSEMFKIEKDEIEEEVEEIKAMSMDIFDDDRKDVDGTVPFELSFDYESSHKTSEEEVMKNVESSGECVVKVKEEEHKNVLMLRLNYDSVISTWGGQGPPWSSGEPPERDMDISGWPAFSMVENGGESTHQKQYVGGCLPSSGFGDGGREARVSRYREKRRTRLFSKKIRYEVRKLNAEKRPRMKGRFVKRASLAAAASPLGVNY

SEQ ID NO: 275 - DNA, 978 bp, Arabidopsis thaliana
atggggcgatcaccatgttgcgatgagaatggtctaaagaaagggccatggacacaagaggaggatgataaactgatagatcacattcaaaaacatggccatggcagctggagagctcttccaaagcaagccggtttaaaccgatgcggaaagagttgtagattaagatggaccaactacttgagacctgacatcaagagaggaaatttcactgaagaggaagaacaaactattatcaacctccattcccttcttggaaacaagtggtcgtcgatagccggtaatcttcctggaagaacggacaatgaaataaaaaactattggaacacacatttgagaaagaaacttctccaaatggggattgatccggtgacccataggccaagaaccgaccatctaaacgttttagcagctctcccgcagcttatagccgccgcaaatttcaacagcctcttgaatctcaaccaaaatgtgcaactggatgcaacaactcttgctaaagctcaactgctacacactatgattcaagtccttagcaccaataacaacaccaccaatccttctttttcttcatcaactatgcaaaacagtaacaccaatctctttggccaagcttcttacttagagaaccaaaatctttttggtcagtctcaaaacttctctcacattcttgaggatgagaatttgatggtcaaaacccaaattattgataaccctttggactctttttcttcccccatacaacccggttttcaagatgatcataattcactccctctattggttccggcgtctcctgaagaatctaaagaaactcaaaggatgatcaagaacaaagacatcgtcgattaccatcatcatgatgcttcaaacccttcatcatcaaactcaacgtttacacaagatcatcatcacccatggtgtgacactattgatgatggagcaagtgattctttttggaaagagataatagagtaa

SEQ ID NO: 276 - protein, 325 aa, Arabidopsis thaliana
MGRSPCCDENGLKKGPWTQEEDDKLIDHIQKHGHGSWRALPKQAGLNRCGKSCRLRWTNYLRPDIKRGNFTEEEEQTIINLHSLLGNKWSSIAGNLPGRTDNEIKNYWNTHLRKKLLQMGIDPVTHRPRTDHLNVLAALPQLIAAANFNSLLNLNQNVQLDATTLAKAQLLHTMIQVLSTNNNTTNPSFSSSTMQNSNTNLFGQASYLENQNLFGQSQNFSHILEDENLMVKTQIIDNPLDSFSSPIQPGFQDDHNSLPLLVPASPEESKETQRMIKNKDIVDYHHHDASNPSSSNSTFTQDHHHPWCDTIDDGASDSFWKEIIE

SEQ ID NO: 277 - DNA, 1081 bp, Arabidopsis thaliana
aaaaatatgaggaagccagaggtagccattgcagctagtactcaccaagtaaagaagatgaagaagggactttggtctcctgaggaagactcaaagctgatgcaatacatgttaagcaatggacaaggatgttggagtgatgttgcgaaaaacgcaggacttcaaagatgtggcaaaagctgccgtcttcgttggatcaactatcttcgtcctgacctcaagcgtggcgctttctctcctcaagaagaggatctcatcattcgctttcattccatcctcggcaacaggtggtctcagattgcagcacgattgcctggtcggaccgataacgagatcaagaatttctggaactcaacaataaagaaaaggctaaagaagatgtccgatacctccaacttaatcaacaactcatcctcatcacccaacacagcaagcgattcctcttctaattccgcatcttctttggatattaaagacattataggaagcttcatgtccttacaagaacaaggcttcgtcaacccttccttgacccacatacaaaccaacaatccatttccaacgggaaacatgatcagccacccgtgcaatgacgattttaccccttatgtagatggtatctatggagtaaacgcaggggtacaaggggaactctacttcccacctttggaatgtgaagaaggtgattggtacaatgcaaatataaacaaccacttagacgagttgaacactaatggatccggaaacgcacctgagggtatgagaccagtggaagaattttgggaccttgaccagttgatgaacactgaggttccttcgttttacttcaacttcaaacaaagcatatgaatatttttacgtcatcttattcttttttctattgcggtttatactcaagattcttagccacacacacataaatgcaaatatatatacattgttagagagtattttgtatttcgtataatcttttcgtactagggcttgagccttgaggtcccatgtaacgattagtcaatgtaaaacatatatcctataataaataaataaaagaaataataagcacataaaaaaaaaaaaa

SEQ ID NO: 278 - protein, 280 aa, Arabidopsis thaliana
MRKPEVAIAASTHQVKKMKKGLWSPEEDSKLMQYMLSNGQGCWSDVAKNAGLQRCGKSCRLRWINYLRPDLKRGAFSPQEEDLIIRFHSILGNRWSQIAARLPGRTDNEIKNFWNSTIKKRLKKMSDTSNLINNSSSSPNTASDSSSNSASSLDIKDIIGSFMSLQEQGFVNPSLTHIQTNNPFPTGNMISHPCNDDFTPYVDGIYGVNAGVQGELYFPPLECEEGDWYNANINNHLDELNTNGSGNAPEGMRPVEEFWDLDQLMNTEVPSFYFNFKQSI

SEQ ID NO: 279 - DNA, 1020 bp, Arabidopsis thaliana
gaagatcataaagatcaaaaggagagaggtattaaaaaatgatgtgtagtcgaggccattggagacctgcagaagacgagaagctaagagaactcgtcgagcaatttggtcctcataattggaacgccatagctcagaagctctctggtcgatctggtaagagttgtagattgagatggtttaatcaattggatcctaggattaaccgaaaccctttcacggaggaagaagaagaaaggcttttagcgcctcatcggatccatgggaacagatggtctgtgatcgctagattttttcccggtcgaactgataacgctgttaaaaaccattggcacgtcatcatggctcgtcgtggccgagaacggtccaagctccgtccacgaggccttggccatgatggcacggtggctgcgactgggatgattggtaattataaagactgcgataaggagagaagattggcaaccacaaccgctatcaattttccttatcaattctctcatattaatcattttcaagtcctcaaagagtccttgaccggaaagatcgggttcagaaatagtactactccaatacaagaaggagcaatagaccaaactaaacgaccgatggagttctacaattttctccaagtaaacacggattcgaagatacacgaattgatagataattcaagaaaagacgaagaagaagatgtcgatcaaaacaaccgaattcgtaacgagaattgtgttccatttttcgactttttgtctgttggaaactctgcctctcagggtttatgttaatttgtccgtaccacatgtactataaggtggaccatatgttaactaaagataatgtagaaagtactaatcaattagagctcctgtttgagccaaatgtgaaaattagttaagacatcccaaacattttcttgtataacacatataaggttgtacttttatcaggtctaattttctatttttattttaaggatgtttaatcagacccataaccattcgataaaaaaaaaaaaaa

SEQ ID NO: 280 - protein, 249 aa, Arabidopsis thaliana
MMCSRGHWRPAEDEKLRELVEQFGPHNWNAIAQKLSGRSGKSCRLRWFNQLDPRINRNPFTEEEEERLLAPHRIHGNRWSVIARFFPGRTDNAVKNHWHVIMARRGRERSKLRPRGLGHDGTVAATGMIGNYKDCDKERRLATTTAINFPYQFSHINHFQVLKESLTGKIGFRNSTTPIQEGAIDQTKRPMEFYNFLQVNTDSKIHELIDNSRKDEEEDVDQNNRIRNENCVPFFDFLSVGNSASQGLC

SEQ ID NO: 281 - DNA, 981 bp, Arabidopsis thaliana
gtaccggcgacctctttgtgggtcactcttcatcaatgggtgacaaaggaaggagcttaaagatcaacaagaacatggaggaattcacgaaagtggaagaagaaatggacgtaaggagaggtccatggacagttgaggaagatttagagctcatcaattacattgctagtcatggtgaaggtcgatggaactctctcgctcgttgcgccgaactcaaaaggaccggaaaaagctgcagacttcggtggctgaactatctccgaccagatgtgcgccgtggaaacataaccctcgaagaacaactcttgattcttgaacttcacacacgttggggcaatagatggtctaagattgcacaatatttaccaggaagaacggataacgagatcaaaaactattggagaacacgtgttcaaaagcatgcaaaacagcttaaatgcgacgtgaacagtcaacaatttaaagacaccatgaagtatctttggatgcctcggctcgtagaaaggatccaagccgcgtccatcgggtctgtttccatgtcatcttgcgtcaccacctcctcagatcagttcgtgatcaacaacaacaacaccaacaacgtggataatttggctttaatgagtaaccctaatggttacatcacgccggataattccagcgtggcagtatctcctgtatcagatttgacggagtgtcaagtgagtagtgaagtgtggaagattggtcaggatgagaatttggtggatccaaaaatgacatcgccgaattatatggataatagcagtggactattaaacggagattttacgaagatgcaagatcaaagtgaccttaattggtttgaaaatattaatgggatggtaccaaattattcggacagtttttggaacattggaaatgatgaagacttctggctcttacaacaacatcaacaagtccacgacaatggaagcttctgaatagacaagaagctatgcggcc

SEQ ID NO: 282 - protein, 307 aa, Arabidopsis thaliana
MGDKGRSLKINKNMEEFTKVEEEMDVRRGPWTVEEDLELINYIASHGEGRWNSLARCAELKRTGKSCRLRWLNYLRPDVRRGNITLEEQLLILELHTRWGNRWSKIAQYLPGRTDNEIKNYWRTRVQKHAKQLKCDVNSQQFKDTMKYLWMPRLVERIQAASIGSVSMSSCVTTSSDQFVINNNNTNNVDNLALMSNPNGYITPDNSSVAVSPVSDLTECQVSSEVWKIGQDENLVDPKMTSPNYMDNSSGLLNGDFTKMQDQSDLNWFENINGMVPNYSDSFWNIGNDEDFWLLQQHQQVHDNGSF

SEQ ID NO: 283 - DNA, 1001 bp, Arabidopsis thaliana
gcgcgattaaaaactctcaacttttctctcaaatttctgatcctttgatccaacagttagaagaagattcatctgatcatggccctcgaagcgatgaacactccaacttcttctttcaccagaatcgaaacgaaagaagatttgatgaacgacgccgttttcattgagccgtggcttaaacgcaaacgctccaaacgtcagcgttctcacagcccttcttcgtcttcttcctcaccgcctcgatctcgacccaaatcccagaatcaagatcttacggaagaagagtatctcgctctttgtctcctcatgctcgctaaagatcaaccgtcgcaaacgcgatttcatcaacagtcgcaatcgttaacgccgccgccagaatcaaagaaccttccgtacaagtgtaacgtctgtgaaaaagcgtttccttcctatcaggctttaggcggtcacaaagcaagtcaccgaatcaaaccaccaaccgtaatctcaacaaccgccgatgattcaacagctccgaccatctccatcgtcgccggagaaaaacatccgattgctgcctccggaaagatccacgagtgttcaatctgtcataaagtgtttccgacgggtcaagctttaggcggtcacaaacgttgtcactacgaaggcaacctcggcggcggaggaggaggaggaagcaaatcaatcagtcacagtggaagcgtgtcgagcacggtatcggaagaaaggagccaccgtggattcatcgatctaaacctaccggcgttacctgaactcagccttcatcacaatccaatcgtcgacgaagagatcttgagtccgttgaccggtaaaaaaccgcttttgttgaccgatcacgaccaagtcatcaagaaagaagatttatctttaaaaatctaatactcgactattaattcttgtgtgatttttttcgttacaaccatagtttcattttcatttttttagttacaaatttttaattgttctgatttggattgaaa

SEQ ID NO: 284 - protein, 273 aa, Arabidopsis thaliana
MALEAMNTPTSSFTRIETKEDLMNDAVFIEPWLKRKRSKRQRSHSPSSSSSSPPRSRPKSQNQDLTEEEYLALCLLMLAKDQPSQTRFHQQSQSLTPPPESKNLPYKCNVCEKAFPSYQALGGHKASHRIKPPTVISTTADDSTAPTISIVAGEKHPIAASGKIHECSICHKVFPTGQALGGHKRCHYEGNLGGGGGGGSKSISHSGSVSSTVSEERSHRGFIDLNLPALPELSLHHNPIVDEEILSPLTGKKPLLLTDHDQVIKKEDLSLKI

SEQ ID NO: 285 - DNA, 1047 bp, Arabidopsis thaliana
atggaaagtctcgcacacattcctcccggttatcgattccatccgaccgatgaagaactcgttgactattatctcaagaacaaagttgcattcccgggaatgcaagttgatgttatcaaagatgttgatctctacaaaatcgagccatgggacatccaagagttatgtggaagagggacaggagaagagagggaatggtatttctttagccacaaggacaagaaatatccaactgggacacgaaccaatagagcaacgggctccggattttggaaagcaacgggtcgagacaaggccatttactcaaagcaagagcttgttgggatgaggaagactcttgtcttttacaaaggtagggccccaaatggtcagaaatctgattggataatgcacgaataccgtcttgagaccgatgaaaatggaccgcctcatgaggaaggatgggtggtttgtcgcgctttcaagaagaagctaaccacgatgaactacaacaatccaagaacaatgatgggatcatcatcaggccaagaatctaactggttcacgcagcaaatggatgtggggaatggtaattactatcatcttcctgatctagagagtccgagaatgtttcaaggctcatcatcatcatcactatcatcattacatcagaatgatcaagacccttatggtgtcgtactcagcactattaacgcaaccccaactacaataatgcaacgagatgatggtcatgtgattaccaatgatgatgatcatatgatcatgatgaacacaagtactggtgatcatcatcaatcaggattactagtcaatgatgatcataatgatcaagtaatggattggcaaacgcttgacaagtttgttgcttctcagctaatcatgagccaagaagaggaagaagttaacaaagatccatcagataattcttcgaatgaaacatttcatcatctctctgaagagcaagctgcaacaatggtttcgatgaatgcttcttcctcttcttctccatgttccttctactcttgggctcaaaatacacacacgtaa

SEQ ID NO: 286 - protein, 348 aa, Arabidopsis thaliana
MESLAHIPPGYRFHPTDEELVDYYLKNKVAFPGMQVDVIKDVDLYKIEPWDIQELCGRGTGEEREWYFFSHKDKKYPTGTRTNRATGSGFWKATGRDKAIYSKQELVGMRKTLVFYKGRAPNGQKSDWIMHEYRLETDENGPPHEEGWVVCRAFKKKLTTMNYNNPRTMMGSSSGQESNWFTQQMDVGNGNYYHLPDLESPRMFQGSSSSSLSSLHQNDQDPYGVVLSTINATPTTIMQRDDGHVITNDDDHMIMMNTSTGDHHQSGLLVNDDHNDQVMDWQTLDKFVASQLIMSQEEEEVNKDPSDNSSNETFHHLSEEQAATMVSMNASSSSSPCSFYSWAQNTHT

SEQ ID NO: 287 - DNA, 1257 bp, Arabidopsis thaliana
atgggagatagaaacaacgacggtgatcagaaaatggaggatgtattgttgcccggatttaggtttcatccaaccgacgaagagctcgtaagcttctacctgaagcggaaggttcaacacaaccctctctccattgagctcataagacaactcgatatctacaaatatgacccctgggatcttccaaagtttgcgatgacgggtgaaaaagaatggtacttttattgtccaagggacaggaagtataggaacagctcgaggccaaaccgagtgaccggagctggtttttggaaagccacgggaacggaccggccgatatactcgtcagaaggaaacaaatgcataggtttaaagaagtccttagtgttctacaaaggaagagcagcgaaaggagttaagactgattggatgatgcatgagtttcgtttgccttctctctccgaaccatctcctccttctaagagattcttcgactctcctgtctctcccaacgattcatgggctatatgcagaatcttcaaaaagaccaacacaacgaccctaagagctctctctcactcttttgtttcctcgttaccaccagaaacaagcaccgacacaatgtctaaccaaaagcaatcaaacacataccatttttcttcagacaagatcctcaaacctagctctcacttccagtttcaccatgagaatatgaacactcccaaaactagtaatagtacaactccatccgttcccactataagtcccttctcttacttggatttcacttcatacgacaaacccaccaacgttttcaatccggtttcatgtttagaccaacaatacctcacaaatctctttcttgccacacaagaaacacaacctcagtttcccaggctcccctcgtcaaatgaaatcccatcgtttctgctaaacacgtcttcagattcgaccttcttgggagaattcacgagccatatcgacctcagcgcagtgttggcccaagagcaatgtcccccgcttgtaagcctaccacaggagtatcaagagacgggattcgaaggaaatggtataatgaagaacatgcgtggttccaatgaagatcatcttggtgatcattgcgacacacttcggtttgatgatttcacttcaacaattaatgagaaccatcgtcatcatcaagacctgaaacagaacatgacattgctggagagttattattcttctttatcgtccatcaatagcgatttgccagcttgtttctccagtacaacctga

SEQ ID NO: 288 - protein, 418 aa, Arabidopsis thaliana
MGDRNNDGDQKMEDVLLPGFRFHPTDEELVSFYLKRKVQHNPLSIELIRQLDIYKYDPWDLPKFAMTGEKEWYFYCPRDRKYRNSSRPNRVTGAGFWKATGTDRPIYSSEGNKCIGLKKSLVFYKGRAAKGVKTDWMMHEFRLPSLSEPSPPSKRFFDSPVSPNDSWAICRIFKKTNTTTLRALSHSFVSSLPPETSTDTMSNQKQSNTYHFSSDKILKPSSHFQFHHENMNTPKTSNSTTPSVPTISPFSYLDFTSYDKPTNVFNPVSCLDQQYLTNLFLATQETQPQFPRLPSSNEIPSFLLNTSSDSTFLGEFTSHIDLSAVLAQEQCPPLVSLPQEYQETGFEGNGIMKNMRGSNEDHLGDHCDTLRFDDFTSTINENHRHHQDLKQNMTLLESYYSSLSSINSDLPACFSSTT

SEQ ID NO: 289 - DNA, 537 bp, Arabidopsis thaliana
atggcggagtcgcaggccaagagtcccggaggctgtggaagccatgagagtggtggagatcaaagtcccaggtcgttacatgttcgtgagcaagataggtttcttccgattgctaacataagccgtatcatgaaaagaggtcttcctgctaatgggaaaatcgctaaagatgctaaggagattgtgcaggaatgtgtctctgaattcatcagtttcgtcaccagcgaagcgagtgataaatgtcaaagagagaaaaggaagactattaatggagatgatttgctttgggcaatggctactttaggatttgaagactacatggaacctctcaaggtttacctgatgagatatagagagggtgacacaaagggatcagcaaaaggtggggatccaaatgcaaagaaagatgggcaatcaagccaaaatggccagttctcgcagcttgctcaccaaggtccttatgggaactctcaagtaacttttcctctcttctcttcacactcaagcaatacgcatcattctcttctaatttgttaa

SEQ ID NO: 290 - protein, 178 aa, Arabidopsis thaliana
MAESQAKSPGGCGSHESGGDQSPRSLHVREQDRFLPIANISRIMKRGLPANGKIAKDAKEIVQECVSEFISFVTSEASDKCQREKRKTINGDDLLWAMATLGFEDYMEPLKVYLMRYREGDTKGSAKGGDPNAKKDGQSSQNGQFSQLAHQGPYGNSQVTFPLFSSHSSNTHHSLLIC

SEQ ID NO: 291 - DNA, 839 bp, Arabidopsis thaliana
ctctgcctctctctctctctcaaaacccatctcgaaagtctttctctttcgagggtttagatcctccatggaaggcggcggagttgctgacgtggctgtccccggtacgaggaagagagacagaccttacaaaggaattaggatgaggaagtggggaaagtgggtggcggagattcgtgagcctaacaagcgctctaggttatggcttggctcttactctactcccgaggcggcggcgcgagcttacgacacggcggttttctatcttagaggacctacggcgaggcttaacttccctgagcttcttcctggggagaaattctccgacgaggatatgtcggctgcgaccatcaggaagaaagccacggaggtcggtgctcaggttgatgctttgggcacggcggtgcaaaataaccgccaccgtgtttttggtcagaatcgagatagtgatgtggataataagaattttcatcggaattatcaaaacggtgaacgagaagaagaagaagaagatgaggatgacaagagattgaggagtggcggccggttattggatcgggttgacttgaataaattacccgacccggaaagctccgatgaagaatgggaaagcaaacattaaaaatatatagtttggagcggtggctgttgctaacgtacgccaacggcttgcttctacgaatcattagcgccgtttatgatttttttttttttttttttcattatctgaaaatttagggctttttagttattaatttttgttttgtttttttcctttcttgcgagttttgcggtttatggaattttaggctattgcttaacgaaaaaaaaaaaaaaaa

SEQ ID NO: 292 - protein, 184 aa, Arabidopsis thaliana
MEGGGVADVAVPGTRKRDRPYKGIRMRKWGKWVAEIREPNKRSRLWLGSYSTPEAAARAYDTAVFYLRGPTARLNFPELLPGEKFSDEDMSAATIRKKATEVGAQVDALGTAVQNNRHRVFGQNRDSDVDNKNFHRNYQNGEREEEEEDEDDKRLRSGGRLLDRVDLNKLPDPESSDEEWESKH

SEQ ID NO: 293 - DNA, 1059 bp, Arabidopsis thaliana
gtacatttttttttgtatttcaggaaactccgatggcggatctcttcggtggtggccacggcggcgagcttatggaagcacttcaacctttttacaaaagtgcttccacgtctgcttcaaatcctgcgtttgcgtcctcaaacgatgcgtttgcgtctgccccaaacgacctattttcttcttcttcttactataatcctcatgcatctttattcccttcacattccacaacctcttacccggatatttattctggatccatgacctatccatcttcattcgggtcggatcttcaacaacccgaaaactaccaatctcagttccattaccaaaacactatcacttacactcaccaagacaacaacacttgcatgcttaacttcattgagccgagccaaccgggttttatgacccaaccgggtccgagttcgggttcggtttcaaaaccggctaagctctatagaggagtgaggcaaagacattggggaaaatgggtcgcggagatccgtttacccaggaaccgaacccgactttggctcggaacattcgacacggctgaagaagccgcgttggcttatgatcgcgccgcgtttaagcttcgtggtgactcggctcggcttaacttcccagctctccgataccaaaccggctcgtctccgtctgataccggcgaatatggtcctattcaagctgccgtagacgctaaactagaagccatattagctgagccgaagaatcagccgggcaaaacggagaggacgtcgaggaaacgagctaaagccgcggcttcttcagctgagcagccgtcagcgccacaacaacattccgggtcgggtgaaagtgatgggtcgggttcaccgacttcggatgttatggtgcaggagatgtgccaagagccagagatgccatggaatgaaaatttcatgctcggcaagtgtccttcttatgagatagattgggcttcaattttatcgtgaaaaattaggattcaattcatttttattcattttaacttgtttgtattttcttttaaactttagggttattagctgtgcgtaa

SEQ ID NO: 294 - protein, 314 aa, Arabidopsis thaliana
MADLFGGGHGGELMEALQPFYKSASTSASNPAFASSNDAFASAPNDLFSSSSYYNPHASLFPSHSTTSYPDIYSGSMTYPSSFGSDLQQPENYQSQFHYQNTITYTHQDNNTCMLNFIEPSQPGFMTQPGPSSGSVSKPAKLYRGVRQRHWGKWVAEIRLPRNRTRLWLGTFDTAEEAALAYDRAAFKLRGDSARLNFPALRYQTGSSPSDTGEYGPIQAAVDAKLEAILAEPKNQPGKTERTSRKRAKAAASSAEQPSAPQQHSGSGESDGSGSPTSDVMVQEMCQEPEMPWNENFMLGKCPSYEIDWASILS

SEQ ID NO: 295 - DNA, 1674 bp, Arabidopsis thaliana
aggtcgaattttctgaaattaagattcattcctccatggaagaagctctgtttttattctctttagcttagcttagcttctactgatctgtttttgctacaaaatcccatctttttctttaaaactctttatctctgaatcttgagtttcttgtagaagaagaagcaattttgaatctttcgtaatcataaagattcgtggaggatctctactgatttgtcggaatctctcactacagaatcacttgatcttatgtccggatggaggagagagaaggaaccaacatcaacaacaacatcactagcagtttcggcttgaagcagcaacatgaagctgctgcttctgatggtggttactcaatggacccaccaccaagacccgaaaaccctaacccgtttttagtcccacccactactgtccccgcggccgccaccgtagcagcagctgttactgagaatgcggctactccgtttagcttaacaatgccgacggagaacacttcagctgagcagctgaaaaagaagagaggtaggccgagaaagtataatcccgatgggactcttgtcgtgactttatcgccgatgccaatctcgtcctctgttccgttgacgtcggagtttcctccaaggaaacgaggaagaggacgtggcaagtctaatcgatggctcaagaagtctcaaatgttccaattcgatagaagtcctgttgataccaatttggcaggtgtaggaactgctgattttgttggtgccaactttacacctcatgtactgatcgtcaacgccggagaggatgtgacgatgaagataatgacattctctcaacaaggatctcgtgctatctgcatcctttcagctaatggtcccatctccaatgttacgcttcgtcaatctatgacatccggtggtactctaacttatgagggtcgttttgagattctctctttgacgggttcgtttatgcaaaatgactctggaggaactcgaagtagagctggtggtatgagtgtttgccttgcaggaccagatggtcgtgtctttggtggaggactcgctggtctctttcttgctgctggtcctgtccaggtaatggtagggacttttatagctggtcaagagcagtcacagctggagctagcaaaagaaagacggctaagatttggggctcaaccatcttctatctcctttaacatatccgcagaagaacggaaggcgagattcgagaggcttaacaagtctgttgctattcctgcaccaaccacttcatacacgcatgtaaacacaacaaatgcggttcacagttactatacaaactcggttaaccatgtcaaggatcccttctcgtctatcccagtaggaggaggaggaggtggagaggtaggagaagaagagggtgaagaagatgatgatgaattagaaggtgaagacgaagaattcggaggcgatagccaatctgacaacgagattccgagctgatgatgatcatacggtttcttttcgcggatttgttaggtttgatggatttcagattttggttgattgtttttattaacacagaatgtttagaagctgctatctttaggttcccatcctcttgtgattgttgagtatccttgttagaaacaaacttactgttgcaaaactctcttcaaaaaagtttcactttgctttccca

SEQ ID NO: 296 - protein, 404 aa, Arabidopsis thaliana
MEEREGTNINNNITSSFGLKQQHEAAASDGGYSMDPPPRPENPNPFLVPPTTVPAAATVAAAVTENAATPFSLTMPTENTSAEQLKKKRGRPRKYNPDGTLVVTLSPMPISSSVPLTSEFPPRKRGRGRGKSNRWLKKSQMFQFDRSPVDTNLAGVGTADFVGANFTPHVLIVNAGEDVTMKIMTFSQQGSRAICILSANGPISNVTLRQSMTSGGTLTYEGRFEILSLTGSFMQNDSGGTRSRAGGMSVCLAGPDGRVFGGGLAGLFLAAGPVQVMVGTFIAGQEQSQLELAKERRLRFGAQPSSISFNISAEERKARFERLNKSVAIPAPTTSYTHVNTTNAVHSYYTNSVNHVKDPFSSIPVGGGGGGEVGEEEGEEDDDELEGEDEEFGGDSQSDNEIPS

SEQ ID NO: 297 - DNA, 861 bp, Arabidopsis thaliana
ccttatcactcaccaaaagtcgtcacataatatcactttcgagttatcaacatccgtacatgtcatccatagagccaaaagtaatgatggttggtgctaataagaaacaacgaaccgtccaagctagttcgaggaaaggttgtatgagaggaaaaggtggacccgataacgcgtcttgcacttacaaaggtgttagacaacgcacttggggcaaatgggtcgctgagatccgcgagcctaaccgaggagctcgtctttggctcggtaccttcgacacctcccgtgaagctgccttggcttatgactccgcagctcgtaagctctatgggcctgaggctcatctcaacctccctgagtccttaagaagttaccctaaaacggcgtcgtctccggcgtcccagactacaccaagcagcaacaccggtggaaaaagcagcagcgactctgagtcgccgtgttcatccaacgagatgtcatcatgtggaagagtgacagaggagatatcatgggagcatataaacgtggatttgccggtaatggatgattcttcaatatgggaagaagctacaatgtcgttaggatttccatgggttcatgaaggagataatgatatttctcggtttgatacttgtatttccggtggctattctaattgggattcctttcattccccactttgaggtgtcactagactctctttaattgttaagttatcatatacaaactacatatatatacaaatatagtcaccgtgaactaggatatatatgtaaataaacaccagttacatgtacttatatatgtgcacatctatatatgtggtttgtctgtatagtgtgaaagcagattcttaccatatca

SEQ ID NO: 298 - protein, 206 aa, Arabidopsis thaliana
MSSIEPKVMMVGANKKQRTVQASSRKGCMRGKGGPDNASCTYKGVRQRTWGKWVAEIREPNRGARLWLGTFDTSREAALAYDSAARKLYGPEAHLNLPESLRSYPKTASSPASQTTPSSNTGGKSSSDSESPCSSNEMSSCGRVTEEISWEHINVDLPVMDDSSIWEEATMSLGFPWVHEGDNDISRFDTCISGGYSNWDSFHSPL

SEQ ID NO: 299 - DNA, 1651 bp, Arabidopsis thaliana
tctatctctatctatctctctttgtctgcaaatggaagaacatattcaagatcgccgtgaaattgcgttcttacactcaggagaatttctccacggagattctgactcaaaggatcatcaaccgaacgagtctccggtggaacgtcatcacgagtcgtctatcaaagaagttgatttcttcgctgctaaaagtcagccgtttgatcttggtcatgtgagaacaacgacgatcgttggatcatctggttttaatgatggattaggtttggtaaattcatgtcatggaacatcaagcaatgatggcgatgacaaaaccaaaactcaaattagtagactgaagttggagctagagaggcttcacgaggagaatcacaaactgaagcatttattagatgaggtcagtgagagttacaacgacctccaaagaagagttttgttagcaagacaaacacaagtggaaggtcttcatcataaacaacatgaggatgtacctcaagctggttcctcacaagctctagagaacagaagaccaaaggatatgaaccatgaaactccggccaccaccttgaaacgacggtctccagacgacgtggatggtcgtgatatgcaccgaggatcaccaaaaactcctcgaatagaccaaaacaagagtactaatcatgaagaacaacaaaaccctcatgatcaattaccctatagaaaagctagggtttccgttagagctagatctgatgccactacggtaaatgacggatgtcaatggagaaaatacggtcagaaaatggcgaaagggaatccatgtcctcgcgcttattatcgttgcaccatggccgttggatgtcctgtccgtaaacaggtccaacgatgcgcggaggatacaactatcttgacaacaacgtacgaaggaaaccataaccatcctcttcccccgtcagccacagccatggctgcaaccacctccgccgcagcagccatgctcttatcaggctcctcctccagcaacctccaccaaacactctctagcccctccgccacgtcatcatcatccttctaccataacttcccatacacctccacaatcgcaacactctctgcctcagctcctttccccaccataaccttagacctcaccaacccacctcgaccgctacaaccgccaccgcagtttctaagccagtatggtcccgccgcgtttttaccaaacgctaatcaaattaggtctatgaataataataaccagcagttattaatacctaatttgtttggcccacaagccccaccacgtgaaatggtcgattcagttagggctgcgattgcgatggatccgaacttcacggcggcacttgcggccgcgatctcaaacattatcggaggaggtaataacgacaacaataataatactgatattaatgataacaaggttgatgcaaaaagtggagggagtagtaacggagattcgccacagcttcctcagtcttgcaccactttctctacaaactaattttactaccattattatatgttatcttattatatattacacacacatattatacattatgcgtatcttaagtttttttttgggggccattatatatgaatgatatggagatcactgagagagagagagagctattatgggttttttttt

SEQ ID NO: 300 - protein, 489 aa, Arabidopsis thaliana
MEEHIQDRREIAFLHSGEFLHGDSDSKDHQPNESPVERHHESSIKEVDFFAAKSQPFDLGHVRTTTIVGSSGFNDGLGLVNSCHGTSSNDGDDKTKTQISRLKLELERLHEENHKLKHLLDEVSESYNDLQRRVLLARQTQVEGLHHKQHEDVPQAGSSQALENRRPKDMNHETPATTLKRRSPDDVDGRDMHRGSPKTPRIDQNKSTNHEEQQNPHDQLPYRKARVSVRARSDATTVNDGCQWRKYGQKMAKGNPCPRAYYRCTMAVGCPVRKQVQRCAEDTTILTTTYEGNHNHPLPPSATAMAATTSAAAAMLLSGSSSSNLHQTLSSPSATSSSSFYHNFPYTSTIATLSASAPFPTITLDLTNPPRPLQPPPQFLSQYGPAAFLPNANQIRSMNNNNQQLLIPNLFGPQAPPREMVDSVRAAIAMDPNFTAALAAAISNIIGGGNNDNNNNTDINDNKVDAKSGGSSNGDSPQLPQSCTTFSTN

SEQ ID NO: 301 - DNA, 1293 bp, Arabidopsis thaliana
atgggaacaagagcagaacgcaaggaagattttgttggtgggtttggatttggtgttgtagaaaattcgcataaagacgttatggtgctacctcatcatcactattatccatcatattcatcaccttcctcttcttctttgtgttactgttctgctggtgttagcgatcccatgttctctgtttctagcaatcaggcttacacttcttctcacagtggtatgttcacacccgccggttctggttctgctgctgtgactgtagcagatccttttttctccttgagctcttcaggggaaatgagaagaagtatgaacgaagatgctggtgcagctttcagcgaagctcaatggcatgagcttgagaggcagaggaatatatacaagtacatgatggcttctgttcctgttcctccagagcttctcacaccctttcccaagaaccaccaatcaaacactaacccggatgtaactgtggcagtggcgacaggaggctcattgcagctggggattgcttcaagcgcaagcaataacacggctgatctggagccatggaggtgcaagagaacagatgggaagaaatggaggtgctctagaaacgtgattcctgatcagaaatactgtgagagacacacacacaagagccgtcctcgttcaagaaagcatgtggaatcatctcaccaatcatctcaccacaatgacattcgtacggctaagaatgatactagccagcttgtgagaacttatcctcagttttacggacaacctataagccagatccctgtgctttctactcttccgtctgcctcctctccatatgatcaccacagaggactgaggtggtttacgaaagaagatgatgccattggaaccttaaacccggagactcaagaagctgtccagctgaaagttggatcaagcagagagctcaaacggggattcgattatgatctgaatttcaggcagaaagagccaatagtagaccagagctttggagcattgcagggtctattaagtctaaaccagacaccacaacataaccaagaaacaagacagtttgttgtagaaggaaagcaagatgaagcgatgggaagctctctgacactctcaatggctggaggaggcatggaggaaacagagggaacaaaccagcatcagtgggttagccatgaaggtccatcatggctctattcaacaacaccaggtggaccattggctgaagcactgtgtctcggtgtctccaacaacccaagttctagtactactactagtagctgcagcagaagctcaagctaa

SEQ ID NO: 302 - protein, 430 aa, Arabidopsis thaliana
MGTRAERKEDFVGGFGFGVVENSHKDVMVLPHHHYYPSYSSPSSSSLCYCSAGVSDPMFSVSSNQAYTSSHSGMFTPAGSGSAAVTVADPFFSLSSSGEMRRSMNEDAGAAFSEAQWHELERQRNIYKYMMASVPVPPELLTPFPKNHQSNTNPDVTVAVATGGSLQLGIASSASNNTADLEPWRCKRTDGKKWRCSRNVIPDQKYCERHTHKSRPRSRKHVESSHQSSHHNDIRTAKNDTSQLVRTYPQFYGQPISQIPVLSTLPSASSPYDHHRGLRWFTKEDDAIGTLNPETQEAVQLKVGSSRELKRGFDYDLNFRQKEPIVDQSFGALQGLLSLNQTPQHNQETRQFVVEGKQDEAMGSSLTLSMAGGGMEETEGTNQHQWVSHEGPSWLYSTTPGGPLAEALCLGVSNNPSSSTTTSSCSRSSS

SEQ ID NO: 303 - DNA, 1319 bp, Arabidopsis thaliana
ctagtagtgatgatatgatcgcttcttctcctacaatctcagaaacctccgatcacggttttagatatcttctacaacggatacaatggagagcaccgattcttccggtggtccaccaccgccacaacctaaccttcctccaggcttccggtttcaccctaccgacgaagagcttgttgttcactacctcaaacgcaaagcagcctctgctcctttacctgtcgccatcatcgccgaagtcgatctctataaatttgatccatgggaacttcccgctaaagcatcgtttggagaacaagaatggtacttctttagtccacgagatcggaagtatccaaacggagcaagaccaaacagagcggcgacttcaggttattggaaagcgaccggtacagataaaccggtacttgcttccgacggtaaccaaaaggtgggcgtgaagaaggcactagtcttctacagtggtaaaccaccaaaaggcgttaaaagtgattggatcatgcatgagtatcgtctcatcgaaaacaaaccaaacaatcgacctcctggctgtgatttcggcaacaaaaaaaactcactcagacttgatgattgggtgttatgtagaatctacaagaagaacaacgcaagtcgacatgttgataacgataaggatcatgatatgatcgattacattttcaggaagattcctccgtctttatcaatggcggctgcttctacaggacttcaccaacatcatcataatgtctcaagatcaatgaatttcttccctggcaaattctccggtggtggttacgggattttctctgacggtggtaacacgagtatatacgacggcggtggcatgatcaacaatattggtactgactcagtagatcacgacaataacgctgacgtcgttggtttaaatcatgcttcgtcgtcaggtcctatgatgatggcgaatttgaaacgaactctcccggtgccgtattggcctgtagcagatgaggagcaagatgcatctccgagcaaacggtttcacggtgtaggaggaggaggaggagattgttcgaacatgtcttcctccatgatggaagagactccaccattgatgcaacaacaaggtggtgtgttaggagatggattattcagaacgacatcgtaccaattacccggtttaaattggtactcttcttaatcaaatgtgtttcgccgccggtgtgaagaattttccggtgacagtgaagatttttttccgattggtggggtcatttgcatgcattatataatttgagatttgtgtatatgttttgggttaattaattggtcacaggggc

SEQ ID NO: 304 - protein, 364 aa, Arabidopsis thaliana
MESTDSSGGPPPPQPNLPPGFRFHPTDEELVVHYLKRKAASAPLPVAIIAEVDLYKFDPWELPAKASFGEQEWYFFSPRDRKYPNGARPNRAATSGYWKATGTDKPVLASDGNQKVGVKKALVFYSGKPPKGVKSDWIMHEYRLIENKPNNRPPGCDFGNKKNSLRLDDWVLCRIYKKNNASRHVDNDKDHDMIDYIFRKIPPSLSMAAASTGLHQHHHNVSRSMNFFPGKFSGGGYGIFSDGGNTSIYDGGGMINNIGTDSVDHDNNADVVGLNHASSSGPMMMANLKRTLPVPYWPVADEEQDASPSKRFHGVGGGGGDCSNMSSSMMEETPPLMQQQGGVLGDGLFRTTSYQLPGLNWYSS

SEQ ID NO: 305 - DNA, 1272 bp, Arabidopsis thaliana
atgatgaaaggtctgattgggtatagatttagtccgacgggagaggaagtgatcaaccattacctaaagaacaaacttctgggtaagtattggctcgttgatgaagctattagcgagatcaacatcttgagtcacaaacccagcaaggatttgcctaagttagctaggatccaatcggaagatcttgaatggtatttcttctctccgattgagtacacgaacccgaataagatgaaaatgaagaggacgacaggttctgggttttggaaacctactggtgttgatcgggaaattagggataaaagaggaaatggtgttgtgatagggattaagaagacgcttgtgtaccatgaaggtaagagtcctcatggagttagaactccttgggttatgcacgagtatcacatcacttgcttgcctcatcataagaggaaatatgttgtctgccaagtaaagtataagggtgaagctgcagaaatttcatatgagccaagtccctctttggtatccgattcgcataccgtcatagcgattaccggagaaccggaacctgagcttcaggttgagcagccaggtaaagaaaatctcttgggtatgtctgtagatgatttgatagaaccaatgaaccaacaagaggagccacaaggtcctcacttagctccgaatgatgatgagtttatacgtggattgaggcatgttgatcgagggacggttgaatatttgtttgccaatgaagaaaacatggatggtttgtctatgaatgacttgagaatcccaatgatcgtccaacaagaggatctctctgagtgggagggatttaacgcagacacctttttcagcgacaacaacaataactataaccttaacgtgcatcatcaactaacgccttacggcgatggctatttgaatgcattttcgggttataacgaagggaatcctcccgatcacgaattagtgatgcaagagaaccgcaacgatcacatgccaaggaaacctgtgacagggaccattgattatagcagcgatagtggcagtgatgctggatccatatctacaacggtgaaacaagaaatcccaagagctgttgatgcacccatgaacaatgagtcatctttggtgaaaacagagaagaaaggcttgtttattgtagaggacgcaatggagagaaaccgcaagaaaccacgatttatctatctcatgaagatgatcataggcaacatcatatcggttttactacccgtcaaaagattgatcccggtgaagaagttatga

SEQ ID NO: 306 - protein, 423 aa, Arabidopsis thaliana
MMKGLIGYRFSPTGEEVINHYLKNKLLGKYWLVDEAISEINILSHKPSKDLPKLARIQSEDLEWYFFSPIEYTNPNKMKMKRTTGSGFWKPTGVDREIRDKRGNGVVIGIKKTLVYHEGKSPHGVRTPWVMHEYHITCLPHHKRKYVVCQVKYKGEAAEISYEPSPSLVSDSHTVIAITGEPEPELQVEQPGKENLLGMSVDDLIEPMNQQEEPQGPHLAPNDDEFIRGLRHVDRGTVEYLFANEENMDGLSMNDLRIPMIVQQEDLSEWEGFNADTFFSDNNNNYNLNVHHQLTPYGDGYLNAFSGYNEGNPPDHELVMQENRNDHMPRKPVTGTIDYSSDSGSDAGSISTTVKQEIPRAVDAPMNNESSLVKTEKKGLFIVEDAMERNRKKPRFIYLMKMIIGNIISVLLPVKRLIPVKKL

SEQ ID NO: 307 - DNA, 1034 bp, Arabidopsis thaliana
  misc_feature (1029)..(1029): n=a,t,c or g
cgtcgaccttcactcaaaccctaatcccgggaacccgggaattttgatcattttgtttcttttcgatctgtttctattttaaaaagatgatgaaagatccgactgggtatagatttagtccgacgggagaggaagtgataaaccattacctaaagaacaaaattctgggtaagacttggctcgttgatgaagccattagcgagatcaacatcttgaatcacaaacccagcaaggatttgcctaagttagctaggatccaatcggaagatcttgagtggtactttttctctccgattgagtacacgaacccgaataagatgaaaatgaagaggacgacaggttctgggttttggaaacctagtggtgttgatcggaaaattagggataaaagaggaaatggtgttgtgatagggattaagaagacgcttgtgtaccatgaaggtaagagtcctcatggagttagaactccttgggttatgcacgagtatcacatcacttgcttgcctcatcataagaggaaatatgttgtctgccaagtaaagtataagggtgaagctgcagaaatttcatatgagccaagtccctctttggtatccgattcgcataccgtcatagcgattaacggagaaccggaacctgagcttcaggttgagcagccaggtaaagaaaatctcttgggtatgtctgtagatgatttgatagaaccaatgaaccaacaagaggagccacaaggtcctcacttagctccgaatgatgatgagtttatacgtggattgagacatgttgatcgagagccggttgaatatttgtttgccaatgaagaaaacatggatggtttgtctattatgaatgacttgacaatcccaatgatcgcccaacaagaggatctcattctctctgagtgggagggatttatcgcagccacctttttcagcgacaacaacaataacaataaccttaacgtgcatcaactaacgtctttcttaccgggatgattatcagaatgcattttgggttacaacggagcgnccgct

SEQ ID NO: 308 - protein, 302 aa, Arabidopsis thaliana
MMKDPTGYRFSPTGEEVINHYLKNKILGKTWLVDEAISEINILNHKPSKDLPKLARIQSEDLEWYFFSPIEYTNPNKMKMKRTTGSGFWKPSGVDRKIRDKRGNGVVIGIKKTLVYHEGKSPHGVRTPWVMHEYHITCLPHHKRKYVVCQVKYKGEAAEISYEPSPSLVSDSHTVIAINGEPEPELQVEQPGKENLLGMSVDDLIEPMNQQEEPQGPHLAPNDDEFIRGLRHVDREPVEYLFANEENMDGLSIMNDLTIPMIAQQEDLILSEWEGFIAATFFSDNNNNNNLNVHQLTSFLPG

SEQ ID NO: 309 - DNA, 914 bp, Arabidopsis thaliana
aaatcatcagatagaaggaaatattctgattgagagatggctcgtggaaagattcagcttaagaggattgagaacccggttcacagacaagtgactttttgcaagaggagaactggtcttctcaagaaggctaaggagctctctgtgctctgtgatgccgagatcggtgttgtgatcttctctcctcagggcaagctctttgagctcgctactaaaggaacaatggagggaatgattgataagtacatgaagtgtactggtggtggtcgtggttcttcttctgctacttttactgctcaagaacaacttcaaccaccaaatcttgatccgaaagatgagatcaacgtgcttaagcaagagattgagatgcttcagaaagggataagctatatgtttggaggaggagatggggctatgaatcttgaagaacttcttttgcttgagaagcatcttgagtattggatttctcagattcgctctgctaagatggatgttatgcttcaagaaattcagtcattgaggaacaaggaaggagtcctcaaaaacaccaacaagtatctcctcgacaagatagaggaaaacaacaatagcatattagatgctaacttcgcagtcatggagacaaactattcctatccgctaacaatgccaagtgaaatatttcagttctagaccatagggtatttgaagactatgtctcacgaatttaaataaccttggtaagtataatatagtgttgttaaatcacacataattaaaataaagcctgtggaacttcgctaggcagttgaaaatctatccgtatgttttatcctcttgttttacatttgttggtgtgaagatgaaatgactgcaagtgtggtgtgtacttataactctttctactttctatctatgttttgaatttatggatt

SEQ ID NO: 310 - protein, 211 aa, Arabidopsis thaliana
MARGKIQLKRIENPVHRQVTFCKRRTGLLKKAKELSVLCDAEIGVVIFSPQGKLFELATKGTMEGMIDKYMKCTGGGRGSSSATFTAQEQLQPPNLDPKDEINVLKQEIEMLQKGISYMFGGGDGAMNLEELLLLEKHLEYWISQIRSAKMDVMLQEIQSLRNKEGVLKNTNKYLLDKIEENNNSILDANFAVMETNYSYPLTMPSEIFQF

SEQ ID NO: 311 - DNA, 735 bp, Arabidopsis thaliana
atggagaaccaatctatgtcttcatcaagctcctccacacacaaacatgatcaaaaactcaaaagttccgttgtggccatggaggtcctggaggagaaggagacagtgaacaatccgccccagtattataataagatctacatctgttacttgtgcaagagagcgttcccaacccctcatgcccttggcggtcacggaaccacccacaaggaggaccgagaattggagaggcaacagatcgagtcaaggctttctaacaaagacaagtctaacttgctctttggtgggtcttcacaagatgttttatcaaatgataatcaccttggactctctcttggtccattgaagtccatagaaggtagcagcagcagcaacaacgttaacccattgcttaatgttggagtccctagaggaaccacagatatgaacatgaacaactatagctcacatgctttatcaactgatgatattaatcttgatcttactcttggtccatctaagtccataggagatagcaacaatatcattaataacaacactaactcatccttcgatgggaatctgatcattcccgttcgtcctcgtgtgtctagataccattttgttgctgggaacccccttgattcaatctctagaaacattcctccttctattacttttcctcatctaaacatcaatctttctcatgattcgttttctttacaagagaatggttcgggctctagtcactcataa

SEQ ID NO: 312 - protein, 244 aa, Arabidopsis thaliana
MENQSMSSSSSSTHKHDQKLKSSVVAMEVLEEKETVNNPPQYYNKIYICYLCKRAFPTPHALGGHGTTHKEDRELERQQIESRLSNKDKSNLLFGGSSQDVLSNDNHLGLSLGPLKSIEGSSSSNNVNPLLNVGVPRGTTDMNMNNYSSHALSTDDINLDLTLGPSKSIGDSNNIINNNTNSSFDGNLIIPVRPRVSRYHFVAGNPLDSISRNIPPSITFPHLNINLSHDSFSLQENGSGSSHS

SEQ ID NO: 313 - DNA, 645 bp, Arabidopsis thaliana
atgaagagaacacatttggcaagttttagtaacagagacaaaacccaagaagaagaaggagaagacggtaatggtgacaacagagtcatcatgaatcactacaagaattacgaagctgggctgatcccatggcctcccaagaattacacttgcagcttctgcaggagagagttcagatctgctcaagcacttggaggccacatgaatgttcatagaagagacagagcaaaactcaggcagatcccttcttggctcttcgaacctcaccaccacacacctattgcaaaccctaaccctaattttagctcttcttcttcctcttcaacaacaacagctcatcttgagccttccctaaccaaccagagatccaaaaccactccttttccttctgcccggtttgatcttttggacagtactactagctatggaggtttgatgatggacagagagaagaacaagagcaatgtatgtagcagagagatcaagaaaagtgccatcgatgcatgtcattcagtaagatgtgagataagccgtggggatctgatgaataagaaagatgatcaagtcatggggttggagcttgggatgagtttgaggaatcccaaccaagttcttgatttggagcttcgactaggctacctctaa

SEQ ID NO: 314 - protein, 214 aa, Arabidopsis thaliana
MKRTHLASFSNRDKTQEEEGEDGNGDNRVIMNHYKNYEAGLIPWPPKNYTCSFCRREFRSAQALGGHMNVHRRDRAKLRQIPSWLFEPHHHTPIANPNPNFSSSSSSSTTTAHLEPSLTNQRSKTTPFPSARFDLLDSTTSYGGLMMDREKNKSNVCSREIKKSAIDACHSVRCEISRGDLMNKKDDQVMGLELGMSLRNPNQVLDLELRLGYL

SEQ ID NO: 315 - DNA, 606 bp, Arabidopsis thaliana
atgttgtcctcggactcgaattacgctagtgatattagcgacgatgcctccgccaccggatcgatagagaatcctatatacaaatgcaagtattgtcctaggaagttcgataaaacacaagcattaggtggtcatcaaaatgcacacagaaaggagagagaggtcgaaaaacaacaaaaagcatttttggcgcatttgaaccgaccagaaccagatctttacgcgtactcgtattcgtatcatcattcatttcctaaccaatacgcactcccaccgggatttgaacagcctcagtacaaagttgatagatcatacaagatgtccatggtctacaaccaatatgtgggatcctcaagctctagctttgcaggactacaaagtgacccaagtcaaggaatgaaccaggattggacctttaccgggatcccattcctaccccaatctcaacctcaaccactatcgtcaccaatatgtttggatctttgccttggcattggtagctcccaaacccaaccacaacctcaagaaccaaatgatgcaacagaagagatggatgctgagaaagaaaatgatggttcttccctttctctctcactcaaactgtga

SEQ ID NO: 316 - protein, 201 aa, Arabidopsis thaliana
MLSSDSNYASDISDDASATGSIENPIYKCKYCPRKFDKTQALGGHQNAHRKEREVEKQQKAFLAHLNRPEPDLYAYSYSYHHSFPNQYALPPGFEQPQYKVDRSYKMSMVYNQYVGSSSSSFAGLQSDPSQGMNQDWTFTGIPFLPQSQPQPLSSPICLDLCLGIGSSQTQPQPQEPNDATEEMDAEKENDGSSLSLSLKL

SEQ ID NO: 317 - DNA, 1020 bp, Arabidopsis thaliana
atggaacaagccgcgttgaagagcagcgtcaggaaagagatggctctcaaaacgacttctccggtttacgaagagtttcttgccgtcaccaccgctcaaaatggcttttccgtcgacgatttctctgtagacgacttgcttgacttgtcaaacgatgacgtttttgccgacgaagaaactgacctcaaggctcaacatgagatggtccgtgtttcctctgaggaacccaacgacgacggagacgctcttcgccggagcagcgatttctccggctgtgacgactttggttctctccctacaagcgaactctctcttccggcggatgatttagcgaaccttgagtggctctctcatttcgtggaggactccttcacggaatattcgggtccaaacctcaccggaaccccgactgagaaaccggcgtggttaacgggtgaccggaaacatcctgtgactgcagtcacggaagagacctgtttcaaatcccctgttccggctaaagcccgtagcaaacgtaaccgcaatggcctcaaggtctggtcgcttggttcgtcgtcctcctcgggtccttcctcgtccggttcgacctcctcctcctcttcgggtccttccagcccgtggttctccggcgctgagctgctcgagcctgtggtcacgtcagagaggccaccgtttcccaagaagcataagaaaaggtcagccgagtctgttttctccggtgagctgcagcagctgcaacctcagcgaaagtgcagccactgcggcgttcagaaaactccgcagtggagagccgggccaatgggagccaagaccctgtgcaatgcgtgcggtgtccggtacaagtcgggtaggttgctaccggaatacagacccgcttgtagcccgacattctcgagtgagctgcactcgaaccaccaccggaaagtcatagagatgaggcggaagaaggagccaaccagtgacaacgaaaccggtttaaaccagctggttcagtccccacaagctgtaccaagtttttga

SEQ ID NO: 318 - protein, 339 aa, Arabidopsis thaliana
MEQAALKSSVRKEMALKTTSPVYEEFLAVTTAQNGFSVDDFSVDDLLDLSNDDVFADEETDLKAQHEMVRVSSEEPNDDGDALRRSSDFSGCDDFGSLPTSELSLPADDLANLEWLSHFVEDSFTEYSGPNLTGTPTEKPAWLTGDRKHPVTAVTEETCFKSPVPAKARSKRNRNGLKVWSLGSSSSSGPSSSGSTSSSSSGPSSPWFSGAELLEPVVTSERPPFPKKHKKRSAESVFSGELQQLQPQRKCSHCGVQKTPQWRAGPMGAKTLCNACGVRYKSGRLLPEYRPACSPTFSSELHSNHHRKVIEMRRKKEPTSDNETGLNQLVQSPQAVPSF

SEQ ID NO: 319 - DNA, 1069 bp, Arabidopsis thaliana
aatcccaacccacacacctctcaaatcctcctctcctcgtttctctttctctcctcttcacagaaccaaaacatatcaaacctttttttctcttgggtttaagtaaaaatcgaatctttgtgtcggtttttagggttcttgaaacgatatgggtaagtctagtggtagaaatggtaacggaagctttaacggcaataaatttcacggagttagaccttacgtacggtctccagttccacggcttagatggacgccggatcttcaccgttgtttcgttcacgccgtcgagattctcggtggtcaacaccgagcaacaccaaaacttgttcttaagatgatggatgtgaagggacttaccatttcacatgtcaaaagccaccttcagatgtatagaggaggttcaaagctcactttggagaaaccagaagaaagctcatcatcttcaataagaagaagacaagacagtgaagaagattattatcttcatgacaacttgtctttacacacaaggaatgattgtcttttgggttttcactcttttcctctttcttcacattcttcatttagaggaggaggaggaggaagaacaaaagagcagcagacttcagagtctggtggttatgatgatgatgctgactttcttcacatcaagaagatgaacgatacgacgacgtttttgtcacatcatttccccaagggaacagaggagtggcgggaacaagaacacgaagaagaagaagaagatttgtcgttgtctctgtcgttaaatcatcatcattggagaagcaatggatcatcggtggtgagcgaaacgagtgaagcagcagtctcgacttgttcagcaccattcgtatccaaagattgctttggttcttcaaagattgatcttaatctgtcaatttctctcctcggtagctaaataagttatgcaagatttaggttcagagaaactattcggatgtgtttttgaaactaggatattgaatgttagtagagaaacctagaaaatgaagtttagataaattatcaacgcagcgttttgatcgcctttgaacggaaaattaacaaa

SEQ ID NO: 320 - protein, 256 aa, Arabidopsis thaliana
MGKSSGRNGNGSFNGNKFHGVRPYVRSPVPRLRWTPDLHRCFVHAVEILGGQHRATPKLVLKMMDVKGLTISHVKSHLQMYRGGSKLTLEKPEESSSSSIRRRQDSEEDYYLHDNLSLHTRNDCLLGFHSFPLSSHSSFRGGGGGRTKEQQTSESGGYDDDADFLHIKKMNDTTTFLSHHFPKGTEEWREQEHEEEEEDLSLSLSLNHHHWRSNGSSVVSETSEAAVSTCSAPFVSKDCFGSSKIDLNLSISLLGS

SEQ ID NO: 321 - DNA, 666 bp, Arabidopsis thaliana
atgtgtgagtcaagcaacaaagtcagagtatcgccatacccgcttcggtcttcgaggaccgacaaacacaaggcgtcagagtcgcctattgagacaggttgggaggatgtgcgtggatgtcatccttacatgtgcgatacgagtgttcgtcactccaattgtttcaagcagttccgcagaaaaaccataaaaaagcgcctataccccaagaccttacattgtcctctctgtagaggtgaagtatccgagacgacaaaggtgacgagcactgcaagaagatttatgaatgctaaaccgaggtcttgctccgtagaggattgcaaattctctgggacgttttctcagcttactaagcacttgaaaactgagcatcgcggtattgtgccaccaaaggtcgatccactgagacaacagagatgggaaatgatggagagacattctgaatacgttgaactcatgactgcagctgggatttcgcgtatggctgaggtgatgcaacaacagcttccccaggatcagaatcatcctcatgtgtttcaagtgaccgttaatggaaccatatggaatctaattgatccgagtcagggaaggaatggattaggcatcaccaactatagcgcaatgcagtttgtaccattaagcataaatcacagtagaactctgtga

SEQ ID NO: 322 - protein, 221 aa, Arabidopsis thaliana
MCESSNKVRVSPYPLRSSRTDKHKASESPIETGWEDVRGCHPYMCDTSVRHSNCFKQFRRKTIKKRLYPKTLHCPLCRGEVSETTKVTSTARRFMNAKPRSCSVEDCKFSGTFSQLTKHLKTEHRGIVPPKVDPLRQQRWEMMERHSEYVELMTAAGISRMAEVMQQQLPQDQNHPHVFQVTVNGTIWNLIDPSQGRNGLGITNYSAMQFVPLSINHSRTL

SEQ ID NO: 323 - DNA, 1227 bp, Arabidopsis thaliana
atctctttactaccagcaagttgttttcttgctaacttcaaacttctctttctcttgttcctctctaagtcttgatcttatttaccgttaactttgtgaacaaaagtcgaatcaaacacacatggagccgccacagcatcagcatcatcatcatcaagccgaccaagaaagcggcaacaacaacaacaagtccggctctggtggttacacgtgtcgccagaccagcacgaggtggacaccgacgacggagcaaatcaaaatcctcaaagaactttactacaacaatgcaatccggtcaccaacagccgatcagatccagaagatcactgcaaggctgagacagttcggaaagattgagggcaagaacgtcttttactggttccagaaccataaggctcgtgagcgtcagaagaagagattcaacggaacaaacatgaccacaccatcttcatcacccaactcggttatgatggcggctaacgatcattatcatcctctacttcaccatcatcacggtgttcccatgcagagacctgctaattccgtcaacgttaaacttaaccaagaccatcatctctatcatcataacaagccatatcccagcttcaataacgggaatttaaatcatgcaagctcaggtactgaatgtggtgttgttaatgcttctaatggctacatgagtagccatgtctatggatctatggaacaagactgttctatgaattacaacaacgtaggtggaggatgggcaaacatggatcatcattactcatctgcaccttacaacttcttcgatagagcaaagcctctgtttggtctagaaggtcatcaagacgaagaagaatgtggtggcgatgcttatctggaacatcgacgtacgcttcctctcttccctatgcacggtgaagatcacatcaacggtggtagtggtgccatctggaagtatggccaatcggaagttcgcccttgcgcttctcttgagctacgtctgaactagctcttacgccggtgtcgctcgggattaaagctctttcctctctctctctctttcgtactcgtatgttcacaactatgcttcgctagtgattaatgatgcagttgttatattagtagttaactagttatctctcgttatgtgtaatttgtaattactagctaagtatcgtctaggtttaattgtaattgacaaccgtttatctctatgatgaataagttaaatttatatat

SEQ ID NO: 324 - protein, 291 aa, Arabidopsis thaliana
MEPPQHQHHHHQADQESGNNNNKSGSGGYTCRQTSTRWTPTTEQIKILKELYYNNAIRSPTADQIQKITARLRQFGKIEGKNVFYWFQNHKARERQKKRFNGTNMTTPSSSPNSVMMAANDHYHPLLHHHHGVPMQRPANSVNVKLNQDHHLYHHNKPYPSFNNGNLNHASSGTECGVVNASNGYMSSHVYGSMEQDCSMNYNNVGGGWANMDHHYSSAPYNFFDRAKPLFGLEGHQDEEECGGDAYLEHRRTLPLFPMHGEDHINGGSGAIWKYGQSEVRPCASLELRLN

SEQ ID NO: 325 - DNA, 2178 bp, Arabidopsis thaliana
atgtctcagtcaaacatggtaccagtggctaacaacggagacaacaacaacgacaacgaaaacaacaacaacaacaacaacaatggtggaactgacaacactaatgctggaaatgattctggagatcaagatttcgacagtgggaatacctcaagtggcaatcatggagaagggttgggaaacaatcaagctcctcgtcataagaagaaaaaatacaatcgtcacacccaacttcagatttcggagatggaagctttcttcagagagtgtcctcacccagatgacaaacaaaggtacgaccttagcgctcaattgggattggaccctgttcagatcaaattctggttccagaacaaacgcactcaaaacaagaatcaacaagaacgctttgagaactcagaacttcggaatctgaacaaccaccttaggtctgaaaatcagcggttacgagaagctattcatcaagccttatgccctaagtgtggaggccaaactgcaattggcgaaatgaccttcgaagagcaccatcttcgcatcctcaacgctcgtttgactgaagagatcaagcaactttccgtgacagcggaaaagatatcaaggcttacggggataccagtaaggagccatccccgtgtgtctcctcctaatcctcctccaaatttcgagttcgggatgggatctaagggaaatgtcggaaaccactcgagggaaaccactggacctgcagatgctaataccaagccgatcatcatggagttggcatttggagccatggaggagctcttggtgatggctcaagtggctgaaccactgtggatgggaggatttaatggcactagcttagctttgaacttggatgaatacgaaaagacgtttcgcacgggtctcggtcctagacttggcgggtttcgaaccgaggcatccagggaaactgcactcgtggcaatgtgtcctactggcattgttgaaatgctcatgcaagagaatctgtggtcaacaatgtttgccggaattgttggtagagccaggactcatgaacagataatggctgatgctgctggaaacttcaatggaaatctccaaataatgagtgctgagtaccaagtgctttccccgctagtcacaacccgcgaaagctacttcgtccgctactgtaagcaacaaggagagggtttgtgggcggtggtcgatatttccatcgaccatctcctcccaaacatcaacctaaaatgtcgccgccgaccctctggatgtctgattcaagaaatgcatagtggttactccaaggttacatgggtggaacatgtggaagtagatgatgcaggaagttacagcatctttgagaaattaatctgtactggtcaagcttttgctgctaaccgctgggttggtacattggtacgccagtgtgagcggatatctagcatcttgtcgacagattttcaatctgtcgattccggtgatcacataacgctaactaaccatggaaagatgagcatgctgaagatagctgagcggattgcgagaaccttctttgctggaatgaccaatgcgacggggtctacaatattttctggtgttgaaggagaagatatcagagtgatgacaatgaagagcgtgaatgatccaggaaagcctcccggtgtcattatttgtgcagccacttccttttggcttcctgctcctcctaacactgtctttgacttcctcagagaggctactcaccgacacaattgggatgttctctgcaacggagagatgatgcacaagatagcagagattacgaatgggatagacaaaaggaactgtgcaagtttactccggcatggacacactagcaagagcaagatgatgatagttcaagagacttctactgacccaacagcttcatttgtgctttatgcgcctgttgatatgacatcaatggatattactctccatggaggtggtgatcctgactttgtggtgatcctgccttctggttttgctatttttccagatggtacgggtaagcctggaggaaaagaaggaggatcacttttgaccatttccttccaaatgctggttgagtcaggtcctgaggctaggctgagtgttagctctgttgcaactactgagaatctgattcgtacaaccgtgcggaggatcaaagatttgtttccttgtcagactgcttga

SEQ ID NO: 326 - protein, 725 aa, Arabidopsis thaliana
MSQSNMVPVANNGDNNNDNENNNNNNNNGGTDNTNAGNDSGDQDFDSGNTSSGNHGEGLGNNQAPRHKKKKYNRHTQLQISEMEAFFRECPHPDDKQRYDLSAQLGLDPVQIKFWFQNKRTQNKNQQERFENSELRNLNNHLRSENQRLREAIHQALCPKCGGQTAIGEMTFEEHHLRILNARLTEEIKQLSVTAEKISRLTGIPVRSHPRVSPPNPPPNFEFGMGSKGNVGNHSRETTGPADANTKPIIMELAFGAMEELLVMAQVAEPLWMGGFNGTSLALNLDEYEKTFRTGLGPRLGGFRTEASRETALVAMCPTGIVEMLMQENLWSTMFAGIVGRARTHEQIMADAAGNFNGNLQIMSAEYQVLSPLVTTRESYFVRYCKQQGEGLWAVVDISIDHLLPNINLKCRRRPSGCLIQEMHSGYSKVTWVEHVEVDDAGSYSIFEKLICTGQAFAANRWVGTLVRQCERISSILSTDFQSVDSGDHITLTNHGKMSMLKIAERIARTFFAGMTNATGSTIFSGVEGEDIRVMTMKSVNDPGKPPGVIICAATSFWLPAPPNTVFDFLREATHRHNWDVLCNGEMMHKIAEITNGIDKRNCASLLRHGHTSKSKMMIVQETSTDPTASFVLYAPVDMTSMDITLHGGGDPDFVVILPSGFAIFPDGTGKPGGKEGGSLLTISFQMLVESGPEARLSVSSVATTENLIRTTVRRIKDLFPCQTA

SEQ ID NO: 327 - DNA, 947 bp, Arabidopsis thaliana
  misc_feature (924)..(933): n=a,t,c or g
aggaagagggagccactcataagaggaagaagagagagatgggtagagggaagatagagataaagaagatagagaatcagacggcgaggcaagtgaccttctccaagagaagaactggtcttataaagaagactcgtgagctctctattctctgtgacgctcacatcggtctcatcgtcttctcagccaccggaaagctttccgagttctgctccgaacagaacaggatgcctcaactcattgaccgatacttgcataccaacggattgcgacttcctgatcatcatgacgaccaggagcaattgcaccatgagatggaactactaagaagagagacatgtaaccttgagcttcgtctgcgtccattccatggacatgacttagcctccattcctcctaatgagcttgacggactcgagagacagctagaacattctgtcctcaaagtccgtgagcgtaagaggaggatgctagaagaagataacaacaacatgtaccgttggcttcatgagcatcgtgcagcgatggagtttcaacaagctgggatagataccaaaccaggggagtatcaacagtttatagagcagcttcagtgctataaaccaggggagtatcagcagtttctagagcagcagcaacaacaaccaaacagcgttcttcagcttgctacacttccttctgagattgatcctacttacaatctccagcttgctcagcctaatcttcaaaacgatccaacggcccagaatgattaatacaattctcaatagatatctactctttctttatggagacagattcatgaacttttattacctatattttgataagccagtgtcttcttttgtgtggctatggaaaccttgtttaaagcacaatgcacttgagttcttggttatataattaatcatcattattacatannaaanaannaaaaaaaaaaaaaa

SEQ ID NO: 328 - protein, 238 aa, Arabidopsis thaliana
MGRGKIEIKKIENQTARQVTFSKRRTGLIKKTRELSILCDAHIGLIVFSATGKLSEFCSEQNRMPQLIDRYLHTNGLRLPDHHDDQEQLHHEMELLRRETCNLELRLRPFHGHDLASIPPNELDGLERQLEHSVLKVRERKRRMLEEDNNNMYRWLHEHRAAMEFQQAGIDTKPGEYQQFIEQLQCYKPGEYQQFLEQQQQQPNSVLQLATLPSEIDPTYNLQLAQPNLQNDPTAQND

SEQ ID NO: 329 - DNA, 1502 bp, Arabidopsis thaliana
attcacatttttatttatctttccatttagccattctgttccctgtctcttcctcctctctttttgacacatcacatcatcatcacatcatcattcaacatcaatcatcatcatatgcatacacatacatctgtgttctgcggatcgagttaattagttatggcttcttcgaatagacactggccaagcatgttcaagtccaaacctcatccccatcaatggcaacatgacatcaactctcctctcttgccttctgcttctcaccgatcttctcctttctcttcaggatgtgaagtggagaggagtccagagccaaaaccaagatggaatccaaagccagagcagattcggatacttgaagcaatctttaactccgggatggtgaatcctccaagagaggagatcaggcttcaagaatacggccaagtcggtgatgctaacgtcttctactggttccaaaaccgtaagtcccgtagtaaacacaaactccgcctcctccacaaccactccaaacactctctccctcaaacgcaaccgcagccgcagccgcaaccttcggcttcctcttcctcttcctcctcctcttcctcctccaaatccaccaaaccccgaaaaagcaagaacaagaacaacactaatctctctttgggtggtagtcaaatgatggggatgtttccaccggaaccggcgtttctcttcccggtctccactgtcggagggtttgaaggtatcaccgtctcatcccaattagggtttctctccggtgatatgattgagcaacaaaaaccggctccaacgtgtaccggactcctgctgagtgagatcatgaacggtagtgtgagttatggaactcatcatcaacaacacttgagtgagaaagaagttgaagaaatgaggatgaagatgttgcaacagccacagactcagatttgttacgctaccactaatcatcaaatagcttcttacaacaacaacaacaacaacaataacatcatgcttcatattcctcccactacttctactgccaccactattactacttcgcattctctcgctactgtcccatcaacttcggaccagcttcaagttcaagcggacgcacgaataagagttttcatcaatgaaatggagcttgaagtgagctcaggaccgttcaatgtgagggatgcatttggggaagaggttgttctgattaattccgcgggtcagcccattgtcaccgatgaatatggcgtcgctcttcaccctcttcaacacggagcctcgtactatctgatctagtcgtgtgggagatttgagtttgaagaagaaattaagacctgtctctttctttcaccatctctcgtacgtaggcttaaatgttaagattttataaagtattggtttcagttacctgttgtgacggtgtttatgtatgagtttcggacaacattcacaaaactctctcgttaaattgttgaccaataatatatgatgtgtgtttcattattatctaaaaaaaa

SEQ ID NO: 330 - protein, 373 aa, Arabidopsis thaliana
MASSNRHWPSMFKSKPHPHQWQHDINSPLLPSASHRSSPFSSGCEVERSPEPKPRWNPKPEQIRILEAIFNSGMVNPPREEIRLQEYGQVGDANVFYWFQNRKSRSKHKLRLLHNHSKHSLPQTQPQPQPQPSASSSSSSSSSSSKSTKPRKSKNKNNTNLSLGGSQMMGMFPPEPAFLFPVSTVGGFEGITVSSQLGFLSGDMIEQQKPAPTCTGLLLSEIMNGSVSYGTHHQQHLSEKEVEEMRMKMLQQPQTQICYATTNHQIASYNNNNNNNNIMLHIPPTTSTATTITTSHSLATVPSTSDQLQVQADARIRVFINEMELEVSSGPFNVRDAFGEEVVLINSAGQPIVTDEYGVALHPLQHGASYYLI

SEQ ID NO: 331 - DNA, 816 bp, Arabidopsis thaliana
atgggctacatctccaacaacaacctcatcaactatttgcccctctctactactcaacctcctcttcttctcacccactgtgatattaacggcaatgatcaccatcagctcataaccgcatcatcaggagaacacgatattgatgaacggaaaaacaacattcctgcggcggcgactttgagatggaatccgacgccagagcagatcacgacgctagaagagctttacagaagcggaacacggacgccgacgacggaacagatccaacagatagcatctaagcttcgtaaatatgggagaatcgaagggaagaacgttttctattggtttcagaatcataaggctagagagagactaaaacgccgccgtcgtgaaggtggtgctattatcaaaccacataaagacgtcaaggattcatcatcaggtggtcatcgagttgatcagacaaagctctgcccatcttttccacacacaaaccgaccacagccacagcatgaattagatcctgcgagttacaataaagacaacaatgctaataatgaagatcatgggacgactgaagaatctgatcagagggcatcagaggttggtaaatacgccacatggagaaatcttgttacttggtcgataactcaacaaccggaagagattaatatcgacgaaaatgtcaacggagaagaagaagaaacgagggacaaccggactttaaatctctttccggttagggagtaccaagagaaaacaggccggttgatagagaagacgaaagcatgcaactactgttactactacgagttcatgcctctgaagaactga

SEQ ID NO: 332 - protein, 271 aa, Arabidopsis thaliana
MGYISNNNLINYLPLSTTQPPLLLTHCDINGNDHHQLITASSGEHDIDERKNNIPAAATLRWNPTPEQITTLEELYRSGTRTPTTEQIQQIASKLRKYGRIEGKNVFYWFQNHKARERLKRRRREGGAIIKPHKDVKDSSSGGHRVDQTKLCPSFPHTNRPQPQHELDPASYNKDNNANNEDHGTTEESDQRASEVGKYATWRNLVTWSITQQPEEINIDENVNGEEEETRDNRTLNLFPVREYQEKTGRLIEKTKACNYCYYYEFMPLKN

SEQ ID NO: 333 - DNA, 2232 bp, Arabidopsis thaliana
atgtaccatccaaacatgtttgagagccatcatatgttcgatatgaccccaaagagtacctctgataacgacttgggaatcaccggtagccgagaagatgactttgagaccaagtcaggtaccgaagtcactactgagaatccttctggtgaagagcttcaagatcctagccaacgtcccaacaaaaagaagcgttaccatcgccacacgcaacgccaaattcaagagctcgaatcattctttaaggaatgtcctcatccagatgataagcaacgaaaagagttgagccgtgatctcaatttagagcctcttcaagttaagttttggttccaaaacaaacgcacacagatgaaggcacaaagtgagaggcatgagaaccagattctaaagtcagacaatgacaagctcagagcagagaacaatagatacaaagaagctctaagcaatgctacatgccctaactgtggcggtccagctgctattggagaaatgtcttttgacgaacaacatctcaggatcgaaaatgctcggctccgcgaagagattgataggatctctgctattgctgcgaaatacgttgggaagccgttaggatcgtctttcgctccactagcgatccacgcgccttctcgttcgcttgatcttgaagttggaaactttgggaaccagacaggctttgtaggagaaatgtatggaacaggggacattttgaggtcagtttcgattccttctgagactgataagcctataatcgtggagctagcggttgcagctatggaggaactcgtgagaatggctcaaactggagatcctttatggctttcaaccgataattcagtcgagattctcaacgaagaagagtatttcagaacgtttccgagaggaattggaccaaagccattaggattaagatcagaggcgtcaagacaatctgcagttgttataatgaatcacatcaatctcgttgagattctcatggatgtgaatcaatggtcttgtgttttctctgggattgtgtcaagagccttgacacttgaagttctttcaactggagttgctgggaactacaacggtgctttacaagtgatgacagctgagtttcaagttccatcacccctagtcccaacgcgtgagaactactttgtgagatactgcaaacaacacagtgacggctcttgggctgtggttgatgtctctttggacagccttagaccaagtactccaatcttaagaactagaagaaggccttcaggttgtctgattcaagaattgcctaatggttattctaaggttacatggatagagcatatggaggtagatgatagatcagttcacaacatgtataaaccgttggttcagtccggtttagctttcggtgcgaaacgttgggtggctacactcgaacgacaatgcgagcggcttgctagctccatggccagcaacattcctggtgatctttccgtgataacgagtcctgaaggaaggaagagtatgttgaagctagctgagagaatggttatgagtttctgcagtggtgttggcgcgtcgactgcacacgcttggacaacaatgtcgacaacaggatccgatgatgttcgggtcatgacccgcaagagtatggatgatccaggaagacctccgggtattgttcttagtgcagctacttcattctggatcccagttgctcccaaacgtgtttttgatttcctccgtgacgaaaattcaagaaaagagtgggatattctgtcaaatggaggtatggttcaggaaatggctcatatagccaatggtcatgaacctggaaactgtgtctccttgctccgagtcaatagtggaaactcgagccagagcaacatgttgattctacaagagagctgtacagatgcatcaggatcgtatgtgatttacgcgccagtggatatagtggcgatgaatgtggttctaagcggtggagatcctgattacgtggcgttgttgccgtctggttttgctattttaccggatggttcggttggaggaggagatgggaatcagcatcaggaaatggtttctactacttcttctgggagttgtggtggttcgcttttaaccgttgcgtttcagattcttgttgactctgttcctacagctaaactctcacttggctcggtggctacggttaatagtctgatcaaatgtacggtggagaggattaaagctgctgtttcttgtgatgttggaggaggagcgtag

SEQ ID NO: 334 - protein, 743 aa, Arabidopsis thaliana
MYHPNMFESHHMFDMTPKSTSDNDLGITGSREDDFETKSGTEVTTENPSGEELQDPSQRPNKKKRYHRHTQRQIQELESFFKECPHPDDKQRKELSRDLNLEPLQVKFWFQNKRTQMKAQSERHENQILKSDNDKLRAENNRYKEALSNATCPNCGGPAAIGEMSFDEQHLRIENARLREEIDRISAIAAKYVGKPLGSSFAPLAIHAPSRSLDLEVGNFGNQTGFVGEMYGTGDILRSVSIPSETDKPIIVELAVAAMEELVRMAQTGDPLWLSTDNSVEILNEEEYFRTFPRGIGPKPLGLRSEASRQSAVVIMNHINLVEILMDVNQWSCVFSGIVSRALTLEVLSTGVAGNYNGALQVMTAEFQVPSPLVPTRENYFVRYCKQHSDGSWAVVDVSLDSLRPSTPILRTRRRPSGCLIQELPNGYSKVTWIEHMEVDDRSVHNMYKPLVQSGLAFGAKRWVATLERQCERLASSMASNIPGDLSVITSPEGRKSMLKLAERMVMSFCSGVGASTAHAWTTMSTTGSDDVRVMTRKSMDDPGRPPGIVLSAATSFWIPVAPKRVFDFLRDENSRKEWDILSNGGMVQEMAHIANGHEPGNCVSLLRVNSGNSSQSNMLILQESCTDASGSYVIYAPVDIVAMNVVLSGGDPDYVALLPSGFAILPDGSVGGGDGNQHQEMVSTTSSGSCGGSLLTVAFQILVDSVPTAKLSLGSVATVNSLIKCTVERIKAAVSCDVGGGA

SEQ ID NO: 335 - DNA, 2385 bp, Arabidopsis thaliana
accaaactcacatagcaatcacacacatctccacaaacacagcttgagatgatcatgaaacacgtgcatcctcagatctctatcaatccagcttggtgaaagaaggtcaagaattgaaagagaatcaaagaaaacgacgtcgtttcattcgtgtgtaacaactactaattatacatagatggctgcttactttcacggaaacccaccggagatctctgccggatccgacggtggtcttcaaacgttgatcctcatgaatccaactacttacgttcagtacacccaacaagacaacgactcgaacaacaacaacaacagcaacaatagcaacaacaacaacacaaacacaaacacaaacaacaacaacagtagtttcgttttcctcgattcccacgcgccgcagccaaacgcgagccagcagttcgtcggaataccactctcaggtcacgaagctgcttccattacagccgccgacaacatctccgtacttcacggttatcctccgcgcgtgcagtacagtctctacggtagccaccaagtggatcccactcaccagcaagccgcgtgtgagacgccacgcgcgcagcaaggcctctctttaaccctctcgtctcaacagcagcagcaacagcaacatcatcaacaacaccagcctattcacgtcggattcgggtccggacatggagaagatatccgggtcgggtctggctctacaggatcgggggtaacaaacggtatagctaatcttgttagctccaagtacttgaaggcagcacaagagcttcttgacgaagtagtcaacgctgattccgatgacatgaacgctaaatcccaactattctcatcgaaaaagggtagttgcggaaatgataaacctgtcggagaatcatcggccggcgctggaggagaaggttccggtggcggagcagaagcagccgggaaacgtccggtggagctaggcacggcagagagacaagaaatacagatgaagaaagcaaaacttagtaacatgcttcatgaggtggagcagagatatagacagtaccaccagcagatgcagatggtgatctcttcgttcgagcaagcggcagggataggatcagcgaagtcatacacgtcgctagcattgaaaaccatatcaagacagttccgttgcttgaaagaggcgatcgctggtcagataaaagcggccaacaagagtcttggggaggaagattcagtgtctggtgttgggaggtttgaggggtcgaggctcaagttcgtggaccaccacttgagacagcaaagagctcttcaacaactgggaatgattcaacatccttccaataatgcttggagacctcaacgtggtctcccagaacgagccgtctcagttctccgtgcttggctcttcgaacactttcttcatccataccctaaggattcggacaagcacatgctagctaagcaaacaggactcactcgtagccaggtgtcgaactggtttataaacgcgagagttcggttatggaaaccaatggtggaggagatgtacatggaggaaatgaaggagcaggcaaagaacatgggatccatggaaaagactcctttggatcaaagcaacgaagattctgcttcaaagtcaacaagtaaccaagaaaagagcccaatggcggacactaattaccatatgaatcccaatcacaacggtgacctagaaggcgtcactggaatgcaaggatgccccaagagactaagaaccagcgacgagacaatgatgcagccaataaatgcggatttcagctccaacgagaagctcacgatgaagattctagaagaacggcaagggataagatcagatggtggctaccctttcatgggtaatttcgggcaataccaaatggatgagatgtcaagatttgatgtagtctcagaccaggagctcatggcgcaaaggtactcaggaaacaacaatggcgtgtccctcacgttaggtttacctcattgtgatagcttgtcgtccacggaccatcagggtttcatgcagacccaccatgggattcctatagggagaagagtgaaaataggagaaacagaggaatatggacccgccaccatcaatggtggtagctcgaccacaaccgcacattcatcagcggcagctgccgcggcttacaatgggatgaacatacagaaccagaagagatatgtggctcagttattgcccgacttcgttgcataaacccatctctctagaaggagaaaccgaaacaggttattatatacgtttctagtttttaattagtatatagtttctcataccattgaaccaaaacaaagaacaaaatttaattttagtctttggttatatatggccgacgggctacgtcagggccctgacgtagc

SEQ ID NO: 336 - protein, 680 aa, Arabidopsis thaliana
MAAYFHGNPPEISAGSDGGLQTLILMNPTTYVQYTQQDNDSNNNNNSNNSNNNNTNTNTNNNNSSFVFLDSHAPQPNASQQFVGIPLSGHEAASITAADNISVLHGYPPRVQYSLYGSHQVDPTHQQAACETPRAQQGLSLTLSSQQQQQQQHHQQHQPIHVGFGSGHGEDIRVGSGSTGSGVTNGIANLVSSKYLKAAQELLDEVVNADSDDMNAKSQLFSSKKGSCGNDKPVGESSAGAGGEGSGGGAEAAGKRPVELGTAERQEIQMKKAKLSNMLHEVEQRYRQYHQQMQMVISSFEQAAGIGSAKSYTSLALKTISRQFRCLKEAIAGQIKAANKSLGEEDSVSGVGRFEGSRLKFVDHHLRQQRALQQLGMIQHPSNNAWRPQRGLPERAVSVLRAWLFEHFLHPYPKDSDKHMLAKQTGLTRSQVSNWFINARVRLWKPMVEEMYMEEMKEQAKNMGSMEKTPLDQSNEDSASKSTSNQEKSPMADTNYHMNPNHNGDLEGVTGMQGCPKRLRTSDETMMQPINADFSSNEKLTMKILEERQGIRSDGGYPFMGNFGQYQMDEMSRFDVVSDQELMAQRYSGNNNGVSLTLGLPHCDSLSSTDHQGFMQTHHGIPIGRRVKIGETEEYGPATINGGSSTTTAHSSAAAAAAYNGMNIQNQKRYVAQLLPDFVA

SEQ ID NO: 337 - DNA, 991 bp, Arabidopsis thaliana
tcaaatttgtcatttgtttattcaaatttttgagaaaatggtgagaagtaccaaaggtcgtcagaaaatagagatgaaaaaaatggaaaacgaaagcaaccttcaggttactttctcaaaaagaagattcggtcttttcaaaaaagctagtgaactttgcacattaagtggtgcagagattctgttgattgtgttctctcctggtgggaaagtgttttcttttggccatccaagtgttcaagaactcattcatcgcttttcgaatcctaaccataattctgccattgtccatcatcagaacaacaatctccaacttgttgaaacccgtccggatagaaatatccaatatctcaacaatatactcactgaggtgctggcaaaccaggaaaaggagaaacagaagagaatggttttggacctattgaaagaatccagagaacaagtaggaaactggtatgaaaaagatgtgaaagatctcgacatgaatgaaaccaaccagctgatatctgctcttcaagatgtgaaaaagaaactggtaagagaaatgtctcaatattctcaagtaaatgtttcgcagaattactttggtcaaagttctggcgtgattggtggtggtaatgttggcattgatctttttgatcaaagaagaaatgcattcaactataatccaaacatggtgtttcccaatcatacaccaccaatgtttggatacaacaatgatggagttctcgttccgatatccaacatgaactacatgtcaagttacaacttcaaccagagctagagtctgaagctagaagaacatcctaatcaatatttgcgttattttggctatggttactgttaggattgttcttgtattgtgagacttaagtttgttttttcttttaatttgtttcagttggttggtttttcattttattcgtcgtttgttttcctttgtttttggatatttttgtatcccagaataaatttatttatcctttaaaaa

SEQ ID NO: 338 - protein, 248 aa, Arabidopsis thaliana
MVRSTKGRQKIEMKKMENESNLQVTFSKRRFGLFKKASELCTLSGAEILLIVFSPGGKVFSFGHPSVQELIHRFSNPNHNSAIVHHQNNNLQLVETRPDRNIQYLNNILTEVLANQEKEKQKRMVLDLLKESREQVGNWYEKDVKDLDMNETNQLISALQDVKKKLVREMSQYSQVNVSQNYFGQSSGVIGGGNVGIDLFDQRRNAFNYNPNMVFPNHTPPMFGYNNDGVLVPISNMNYMSSYNFNQS

SEQ ID NO: 339 - DNA, 668 bp, Arabidopsis thaliana
gagtaatcatcaacgattatggcgtcaagtcagtggacgaggtcggaggataagatgtttgagcaagctttggttctttttcctgaaggatctcctaatcggtgggagagaatcgctgatcagcttcataaatctgctggtgaagttagggagcattacgaggtcttggttcatgatgttttcgagattgattctggtcgagttgatgtccctgattacatggatgactcggcggctgcggcggcgggttgggattccgctggtcagatctcttttgggtctaaacatggcgagagtgaacgcaaaagaggaactccttggacagagaacgaacacaaattgtttctgatcggattaaagagatatggtaagggagattggaggagtatctcgagaaacgttgtggtgacgaggacaccgacgcaagtcgcgagtcacgctcagaagtattttctgagacagaactcggtgaagaaggagaggaaaaggtcgagcatccatgatataactacggttgatgctactttggctatgcctgggtctaacatggactggactggccaacacgggagtcctgttcaggcgccgcagcagcaacagattatgtctgagttcggtcagcaattgaatcctggtcatttcgaggattttgggtttcggatgtgatg

SEQ ID NO: 340 - protein, 215 aa, Arabidopsis thaliana
MASSQWTRSEDKMFEQALVLFPEGSPNRWERIADQLHKSAGEVREHYEVLVHDVFEIDSGRVDVPDYMDDSAAAAAGWDSAGQISFGSKHGESERKRGTPWTENEHKLFLIGLKRYGKGDWRSISRNVVVTRTPTQVASHAQKYFLRQNSVKKERKRSSIHDITTVDATLAMPGSNMDWTGQHGSPVQAPQQQQIMSEFGQQLNPGHFEDFGFRM

SEQ ID NO: 341 - DNA, 1077 bp, Arabidopsis thaliana
atgggtcatcactcatgctgcaacaagcaaaaggtgaagagagggctttggtcacctgaagaagacgaaaagctcatcaactacatcaattcatatggccatggatgttggagctctgttcctaaacatgcaggtttgcagagatgtggaaagagttgtagattaagatggataaattatctaagacctgatcttaaacgtggaagcttctctcctcaagaagctgctcttatcattgagcttcacagcattcttggtaacagatgggctcaaattgctaaacatctacctggaagaacagataacgaggtcaagaatttctggaactcgagcattaaaaagaagctcatgtctcaccatcatcacggtcatcatcatcatcatctctcttccatggcgagtttgctcacaaaccttccttatcacaatggattcaaccctactacagtcgacgatgaaagttcaagattcatgtccaatatcatcacaaacactaaccctaatttcatcactccaagccatctctctcttccttctcctcatgttatgaccccattgatgttcccaacctctagagaaggagatttcaagtttctaaccacaaacaacccaaaccaatctcatcaccatgataataaccattacaacaacctcgacattttgtcacccacaccaactataaacaatcatcatcaaccttcactttcttcttgtcctcatgataataatctccaatggccagcgttaccagatttcccagcgagtaccatttctggtttccaagaaacccttcaagattatgatgatgctaataaactcaacgtgtttgtgacaccattcaacgataatgccaaaaagttattatgtggagaagttctcgaaggcaaagtactatcttcctcctcaccaatttcacaagatcacggcctttttcttcccaccacgtacaactttcaaatgacttctacgagtgatcatcaacatcatcatcgagtggactcatacatcaatcacatgatcataccatcatcatcctcatcgtcgccaatctcttgtggacagtacgtcataacttaa

SEQ ID NO: 342 - protein, 358 aa, Arabidopsis thaliana
MGHHSCCNKQKVKRGLWSPEEDEKLINYINSYGHGCWSSVPKHAGLQRCGKSCRLRWINYLRPDLKRGSFSPQEAALIIELHSILGNRWAQIAKHLPGRTDNEVKNFWNSSIKKKLMSHHHHGHHHHHLSSMASLLTNLPYHNGFNPTTVDDESSRFMSNIITNTNPNFITPSHLSLPSPHVMTPLMFPTSREGDFKFLTTNNPNQSHHHDNNHYNNLDILSPTPTINNHHQPSLSSCPHDNNLQWPALPDFPASTISGFQETLQDYDDANKLNVFVTPFNDNAKKLLCGEVLEGKVLSSSSPISQDHGLFLPTTYNFQMTSTSDHQHHHRVDSYINHMIIPSSSSSSPISCGQYVIT

SEQ ID NO: 343 - DNA, 777 bp, Arabidopsis thaliana
atgaaaatgatgcaagaggagggaaaccgaaaaggtccatggacagaacaggaagacatacttctggtaaattttgttcacttatttggagatcgacgatgggattttatagcaaaagtatcaggtttgaacagaacaggaaagagttgcaggctaagatgggttaattacctacatcctggtctcaaacgtggcaagatgacgcctcaagaagagcgcctcgtccttgagcttcacgctaagtggggaaacaggtggtcgaaaatagcccgaaaattgccgggacgaacggataacgagataaagaactactggaggactcatatgaggaagaaagctcaagaaaagaagcgtcctgtttccccaacttcctcattttccaactgcagctcgtcatctgtgaccactaccaccaccaatactcaagatacatcgtgccactcgcgtaaatcttcaggggaagtgagcttttacgacactggaggttcccgatccactagagagatgaatcaagaaaacgaagacgtgtactcgttggatgatatatggagagagattgatcactcagcagtaaacataataaaaccggttaaagacatctactcagaacaaagccattgcttaagttacccaaatctagcttcaccatcatgggaaagctcattggattctatatggaacatggatgcagataaaagtaagatatcgtcttactttgcaaatgatcagtttcctttctgtttccaacacagtagatcaccatggtcgtcaggttaa

SEQ ID NO: 344 - protein, 258 aa, Arabidopsis thaliana
MKMMQEEGNRKGPWTEQEDILLVNFVHLFGDRRWDFIAKVSGLNRTGKSCRLRWVNYLHPGLKRGKMTPQEERLVLELHAKWGNRWSKIARKLPGRTDNEIKNYWRTHMRKKAQEKKRPVSPTSSFSNCSSSSVTTTTTNTQDTSCHSRKSSGEVSFYDTGGSRSTREMNQENEDVYSLDDIWREIDHSAVNIIKPVKDIYSEQSHCLSYPNLASPSWESSLDSIWNMDADKSKISSYFANDQFPFCFQHSRSPWSSG

SEQ ID NO: 345 - DNA, 755 bp, Arabidopsis thaliana
caacacttctcagtgaccgtgagcaacgaattattttcagttcaacgactccgcggaaatggaaaattcagaaaatgttccctcttacgatcaaaacatcaatttcactcctaatttgacgagagatcaagaacatgtgatcatggtctctgctttgcaacaagtaatatccaacgtcggaggtgacacgaactcgaatgcatgggaagctgatcttccacctttgaacgctggcccttgtcctctttgtagtgtcaccggctgctacggttgcgtcttcccacgacacgaggcgataattaagaaggagaagaagcacaaaggagtgaggaaaaaaccatcaggtaaatgggcggcggagatatgggatccgagtttgaaagtaaggagatggcttggaacgtttccaacagcggagatggcggctaaggcttacaacgatgcggcggctgagtttgtcggaagaagatcagcaagacgtggcacaaagaacggagaggaagcatctaccaagaagacgactgagaaaaattaacggagaaggagcacgtatagaaaggcaggaagaggcatcttacttgcttcacaagtaaatcagaatttttttgaaaagtaaaaacgttattttgtttggtaataaaataaagtaaaacaaaatattgctaacgcaagacttatcaagttcagtcgtgactgtgagtgtgtttttatgtatcttacttcattttttgtctttcaattgtgtgtgtgtgtgt

SEQ ID NO: 346 - protein, 158 aa, Arabidopsis thaliana
MENSENVPSYDQNINFTPNLTRDQEHVIMVSALQQVISNVGGDTNSNAWEADLPPLNAGPCPLCSVTGCYGCVFPRHEAIIKKEKKHKGVRKKPSGKWAAEIWDPSLKVRRWLGTFPTAEMAAKAYNDAAAEFVGRRSARRGTKNGEEASTKKTTEKN

SEQ ID NO: 347 - DNA, 1123 bp, Arabidopsis thaliana
aaacacaaacaaaactcatattttcaatctccaggtgctttacaccaacagagtcgcaagaaaacaaaaaccaaactcggatttagtttgacagaagaaggaatcgagagtcgggtatgcattatcctaacaacagaaccgaattcgtcggagctccagccccaacccggtatcaaaaggagcagttgtcaccggagcaagagctttcagttattgtctctgctttgcaacacgtgatctcaggggaaaacgaaacggcgccgtgtcagggtttttccagtgacagcacagtgataagcgcgggaatgcctcggttggattcagacacttgtcaagtctgtaggatcgaaggatgtctcggctgtaactactttttcgcgccaaatcagagaattgaaaagaatcatcaacaagaagaagagattactagtagtagtaacagaagaagagagagctctcccgtggcgaagaaagcggaaggtggcgggaaaatcaggaagaggaagaacaagaagaatggttacagaggagttaggcaaagaccttggggaaaatttgcagctgagatcagagatcctaaaagagccacacgtgtttggcttggtactttcgaaaccgccgaagatgcggctcgagcttatgatcgagccgcgattggattccgtgggccaagggctaaactcaacttcccctttgtggattacacgtcttcagtttcatctcctgttgctgctgatgatataggagcaaaggcaagtgcaagcgccagtgtgagcgccacagattcagttgaagcagagcaatggaacggaggaggaggggattgcaatatggaggagtggatgaatatgatgatgatgatggattttgggaatggagattcttcagattcaggaaatacaattgctgatatgttccagtgataaatgagctctttcttgttggcgttttttggagttaagtgcaagaagagattgacactgtggcttgtttaaagtgaacaagaacaagaaagcatgtaattagtagtctcattcttttgtttgtggtcaattctatgtttatctcatataaaatctgagttaaacctatctgaggagagagtaaataaagaggttaagaa

SEQ ID NO: 348 - protein, 268 aa, Arabidopsis thaliana
MHYPNNRTEFVGAPAPTRYQKEQLSPEQELSVIVSALQHVISGENETAPCQGFSSDSTVISAGMPRLDSDTCQVCRIEGCLGCNYFFAPNQRIEKNHQQEEEITSSSNRRRESSPVAKKAEGGGKIRKRKNKKNGYRGVRQRPWGKFAAEIRDPKRATRVWLGTFETAEDAARAYDRAAIGFRGPRAKLNFPFVDYTSSVSSPVAADDIGAKASASASVSATDSVEAEQWNGGGGDCNMEEWMNMMMMMDFGNGDSSDSGNTIADMFQ

SEQ ID NO: 349 - DNA, 933 bp, Arabidopsis thaliana
aaaaaaaaaaaaaaaaaaaaacttatggaatattcccaatcttccatgtattcatctccaagttcttggagctcatcacaagaatcactcttatggaacgagagctgtttcttggatcaatcatctgaacctcaagccttcttttgccctaattatgattactccgatgactttttctcatttgagtcaccggagatgatgattaaggaagaaattcaaaacggcgacgtttctaactccgaagaagaagaaaaggttggaattgatgaagaaagatcatacagaggagtgaggaaaaggccgtgggggaaatttgcagcggagataagagattcaacgaggaatggaattagggtttggctcgggacatttgacaaagccgaggaagccgctcttgcttatgatcaagcggctttcgccacaaaaggatctcttgcaacacttaatttcccggtggaagtggttagagagtcgctaaagaaaatggagaatgtgaatcttcatgatggaggatctccggttatggccttgaagagaaaacattctcttcgaaaccggcctagagggaaaaagcgatcctcttcttcttcttcttcttcttctaattcttcttcttgctcttcttcttcgtctacttcttcaacatcaagaagtagtagtaagcagagtgttgtgaagcaagaaagtggtacacttgtggtttttgaagatttaggtgctgagtatttagaacaacttcttatgagctcatgttgatcttgtaattgatttcagcaaaagccactattaaactttaattttgtgataattaatcttgaaatttgttttgttcattctgcaatttctttggttctcttattttttgtttgttgtatccaaatgaaattattggaagagatggtgatgttaaagtgtatatatataaaaaaaaaa

SEQ ID NO: 350 - protein, 243 aa, Arabidopsis thaliana
MEYSQSSMYSSPSSWSSSQESLLWNESCFLDQSSEPQAFFCPNYDYSDDFFSFESPEMMIKEEIQNGDVSNSEEEEKVGIDEERSYRGVRKRPWGKFAAEIRDSTRNGIRVWLGTFDKAEEAALAYDQAAFATKGSLATLNFPVEVVRESLKKMENVNLHDGGSPVMALKRKHSLRNRPRGKKRSSSSSSSSSNSSSCSSSSSTSSTSRSSSKQSVVKQESGTLVVFEDLGAEYLEQLLMSSC

SEQ ID NO: 351 - DNA, 1135 bp, Arabidopsis thaliana
gtacatttttttttgtatttcaggaaactccgatggcggatctcttcggtggtggccacggcggcgagcttatggaagcacttcaacctttttacaaaagtgcttccacgtctgcttcaaatcctgcgtttgcgtcctcaaacgatgcgtttgcgtctgccccaaacgacccattttcttcttcttcttactataatcctcatgcatctttcttcccttcacattccacaaccacttacccggatatttattctggatccatgacctatccatcttcattcgggtcggatcttcaacaacccgaaaactaccaatctcagttccattaccaaaacactatcacttacactcaccaagacaacaacacttgcatgctcaacttcattgagccgagccaaccggattttatgacccaaccgggtccgagttcgggttcggtttcaaaaccggctaagctctatagaggagtgaggcaaagacattggggaaaatgggtcgcggagatccgtttacccaggaaccgaacccgactttggctcggaacattcgacacggctgaagaagccgcgttggcttatgatcgcgccgcgtttaagcttcgtggtgactcggctcggcttaacttcccagctctccgataccaaaccggctcgtctccgtctgacgttggcgaatacggacctattcaagctgccgttgacgccaagctagaagccatattagctgagccgaagaatcagccgggcaaaacggagaggacgtcgaggaaacgagctaaagccgcggcttcttcagctgagcagccgtcagcgccacaacaacattccgggtcgggtgaaagtgatgggtcgggttcaccgacttcggatgttatggtgcaggagatgtgccaagagccagagatgccatggaatgaaaatttcatgctcggcaagtgtccttcttatgagatagattgggcttcaattttatcgtgaaaaattaggattcaattcatttttattcattttaacttgtttgtattttcttttaaactttagggttattagctgtgcgtaaaatttgtaatttagcattttgtatgaatgtaatgcaagtgtgtaaattatggacagctcaagcttttttgttaaaa

SEQ ID NO: 352 - protein, 314 aa, Arabidopsis thaliana
MADLFGGGHGGELMEALQPFYKSASTSASNPAFASSNDAFASAPNDPFSSSSYYNPHASFFPSHSTTTYPDIYSGSMTYPSSFGSDLQQPENYQSQFHYQNTITYTHQDNNTCMLNFIEPSQPDFMTQPGPSSGSVSKPAKLYRGVRQRHWGKWVAEIRLPRNRTRLWLGTFDTAEEAALAYDRAAFKLRGDSARLNFPALRYQTGSSPSDVGEYGPIQAAVDAKLEAILAEPKNQPGKTERTSRKRAKAAASSAEQPSAPQQHSGSGESDGSGSPTSDVMVQEMCQEPEMPWNENFMLGKCPSYEIDWASILS

SEQ ID NO: 353 - DNA, 1410 bp, Arabidopsis thaliana
aggctattctcggaaaaacaaagaataaagaatgaattcgttttcacaagtacctcctggcttcagatttcatcctactgatgaagaacttgtagactactacttgaggaaaaaagttgcatcaaagagaatagaaatcgatatcatcaaggatgttgatctttacaagattgagccatgtgatcttcaagagttatgcaagataggaaacgaagagcagagcgaatggtacttctttagtcataaagacaagaagtatcccacgggaactcgaaccaatagagccacgaaagcaggattttggaaagccactggaagagacaaggctatatatataagacatagtcttatcggtatgaggaaaacacttgtgttttacaaaggaagagccccaaatggtcagaaatccgattggatcatgcacgaatatcgcttagaaacaagtgaaaatggaacccctcaggaagaaggatgggtagtatgtagggtattcaagaagaaattggcagcgacagtgaggaaaatgggagattaccattcatcaccatcgcagcattggtacgatgatcagctctcttttatggcctccgagatcatttctagttctccacgacagtttcttcccaatcatcattataaccgccaccatcaccagcagacattgccttgtggcctcaatgcattcaacaacaacaatcctaacttgcaatgcaagcaagagctcgagttacattacaatcaaatggtacaacatcaacaacaaaaccatcatcttcgtgaatctatgtttctccagcttcctcagctcgaaagccctaccagtaattgcaattctgacaacaacaataacacaagaaatattagtaacttgcagaaatcatcaaatatatctcatgaggaacaattgcaacaagggaatcaaagtttcagctctctgtattacgatcaaggagtagagcaaatgactactgactggagagttctcgataaatttgttgcttcacagcttagcaatgatgaagaggctgcagccgtggtttcttcttcttctcatcaaaacaacgtcaagattgacacgagaaacacgggttatcatgtgatagatgagggaataaatttgccggagaatgattctgaaagggttgttgaaatgggagaagagtattcaaatgctcatgctgcttctacttcttcaagttgtcagattgatctctagaaatagtgatagagagatgaaaaagatgcaaggtgaatatatatgaaaatacatgcacactagtgttatttatacttaaagatggaaggggaaaaacaaggagttatttcctggatttatggaggttttgtacataataaaaacctacaaccatatggtattttcttttgaaaaaaaaaaaaaaaaaaaaaaaa

SEQ ID NO: 354 - protein, 394 aa, Arabidopsis thaliana
MNSFSQVPPGFRFHPTDEELVDYYLRKKVASKRIEIDIIKDVDLYKIEPCDLQELCKIGNEEQSEWYFFSHKDKKYPTGTRTNRATKAGFWKATGRDKAIYIRHSLIGMRKTLVFYKGRAPNGQKSDWIMHEYRLETSENGTPQEEGWVVCRVFKKKLAATVRKMGDYHSSPSQHWYDDQLSFMASEIISSSPRQFLPNHHYNRHHHQQTLPCGLNAFNNNNPNLQCKQELELHYNQMVQHQQQNHHLRESMFLQLPQLESPTSNCNSDNNNNTRNISNLQKSSNISHEEQLQQGNQSFSSLYYDQGVEQMTTDWRVLDKFVASQLSNDEEAAAVVSSSSHQNNVKIDTRNTGYHVIDEGINLPENDSERVVEMGEEYSNAHAASTSSSCQIDL

SEQ ID NO: 355 - DNA, 1596 bp, Arabidopsis thaliana
atggatactctctttagactagtcagtctccaacaacaacaacaatccgatagtatcattacaaatcaatcttcgttaagcagaacttccaccaccactactggctctccacaaactgcttatcactacaactttccacaaaacgacgtcgtcgaagaatgcttcaactttttcatggatgaagaagacctttcctcttcttcttctcaccacaaccatcacaaccacaacaatcctaatacttactactctcctttcactactcccacccaataccatcccgccacatcatcaaccccttcctccaccgccgcagccgcagctttagcctcgccttactcctcctccggccaccataatgacccttccgcgttctccatacctcaaactcctccgtccttcgacttctcagccaatgccaagtgggcagactcggtccttcttgaagcggcacgtgccttctccgacaaagacactgcacgtgcgcaacaaatcctatggacgctcaacgagctctcttctccgtacggagacaccgagcaaaaactggcttcttacttcctccaagctctcttcaaccgcatgaccggttcaggcgaacgatgctaccgaaccatggtaacagctgcagccacagagaagacttgctccttcgagtcaacgcgaaaaactgtactaaagttccaagaagttagcccctgggccacgtttggacacgtggcggcaaacggagcaatcttggaagcagtagacggagaggcaaagatccacatcgttgacataagctccacgttttgcactcaatggccgactcttctagaagctttagccacaagatcagacgacacgcctcacctaaggctaaccacagttgtcgtggccaacaagtttgtcaacgatcaaacggcgtcgcatcggatgatgaaagagatcggaaaccgaatggagaaattcgctaggcttatgggagttcctttcaaatttaacattattcatcacgttggagatttatctgagtttgatctcaacgaactcgacgttaaaccagacgaagtcttggccattaactgcgtaggcgcgatgcatgggatcgcttcacgtggaagccctagagacgctgtgatatcgagtttccgacggttaagaccgaggattgtgacggtcgtagaagaagaagctgatcttgtcggagaagaagaaggtggctttgatgatgagttcttgagagggtttggagaatgtttacgatggtttagggtttgcttcgagtcatgggaagagagttttccaaggacgagcaacgagaggttgatgctagagcgtgcagcgggacgtgcgatcgttgatcttgtggcttgtgagccgtcggattccacggagaggcgagagacagcgaggaagtggtcgaggaggatgaggaatagtgggtttggagcggtggggtatagtgatgaggtggcggatgatgtcagagctttgttgaggagatataaagaaggtgtttggtcgatggtacagtgtcctgatgccgccggaatattcctttgttggagagatcagccggtggtttgggctagtgcgtggcggccaacgtaa

SEQ ID NO: 356 - protein, 531 aa, Arabidopsis thaliana
MDTLFRLVSLQQQQQSDSIITNQSSLSRTSTTTTGSPQTAYHYNFPQNDVVEECFNFFMDEEDLSSSSSHHNHHNHNNPNTYYSPFTTPTQYHPATSSTPSSTAAAAALASPYSSSGHHNDPSAFSIPQTPPSFDFSANAKWADSVLLEAARAFSDKDTARAQQILWTLNELSSPYGDTEQKLASYFLQALFNRMTGSGERCYRTMVTAAATEKTCSFESTRKTVLKFQEVSPWATFGHVAANGAILEAVDGEAKIHIVDISSTFCTQWPTLLEALATRSDDTPHLRLTTVVVANKFVNDQTASHRMMKEIGNRMEKFARLMGVPFKFNIIHHVGDLSEFDLNELDVKPDEVLAINCVGAMHGIASRGSPRDAVISSFRRLRPRIVTVVEEEADLVGEEEGGFDDEFLRGFGECLRWFRVCFESWEESFPRTSNERLMLERAAGRAIVDLVACEPSDSTERRETARKWSRRMRNSGFGAVGYSDEVADDVRALLRRYKEGVWSMVQCPDAAGIFLCWRDQPVVWASAWRPT

SEQ ID NO: 357 - DNA, 627 bp, Arabidopsis thaliana
atgatgggataccaaacaaactctaatttctccatgtttttttcctcggaaaatgacgaccaaaaccaccacaactacgatccttataataatttctcttcatcaacttctgttgattgcactctctcacttggaacaccctctactcgtctcgacgaccaccatagattttcttctgctaattctaacaacatctccggcgacttttatattcacggaggaaacgctaagacttcttcgtacaagaagggtggtgttgctcatagcctacctcgccgttgtgctagctgcgacaccacttcaactcctctatggagaaacggaccaaaaggacctaagtcgttatgtaacgcgtgtggaatccgattcaagaaagaggagaggcgtgcgacggccagaaacttaacgatctccggtggaggttcatcagcggcagaagtcccagtagagaattcgtacaacggaggtggaaactattacagtcatcatcatcatcactatgcctcgtcgtcgccgtcgtgggctcatcagaacacacaaagagttccatatttctcaccggttccggagatggaatatccctacgtggataacgtcacggcttcttcttttatgtcttggaattga

SEQ ID NO: 358 - protein, 208 aa, Arabidopsis thaliana
MMGYQTNSNFSMFFSSENDDQNHHNYDPYNNFSSSTSVDCTLSLGTPSTRLDDHHRFSSANSNNISGDFYIHGGNAKTSSYKKGGVAHSLPRRCASCDTTSTPLWRNGPKGPKSLCNACGIRFKKEERRATARNLTISGGGSSAAEVPVENSYNGGGNYYSHHHHHYASSSPSWAHQNTQRVPYFSPVPEMEYPYVDNVTASSFMSWN

SEQ ID NO: 359 - DNA, 578 bp, Arabidopsis thaliana
caaggactctgcgacatctgtgcaacatatcatttcctcagaatctctttcttttctaggtttattactacacaaaaccaaacatcatcaactttagttactaaacaatggcatcaggctcaatgtcttcttatggctctggctcatggactgttaagcagaacaaagcctttgagcgtgctctagcagtctatgaccaagacactccggaccgttggcacaatgttgctagagctgttggtggtaaaacaccagaagaagctaagagacagtatgaccttctagttcgtgacatcgaaagcatcgagaatggtcacgtgccattccctgactacaagactactacaggaaacagcaacagaggcaggctgcgtgatgaggaaaagaggatgagaagcatgaagctgcagtgagacaagaagcaacaaaacctaactacgtatgatcgtcaaaataaaagagaatcacttcagagagatgtgtttttttcaatgtctgacgaatcaatgtttttttcttgcaatttctcatgtttttccctaagaaatggtttttttttcgaggcaacaaaaaaaaaa

SEQ ID NO: 360 - protein, 101 aa, Arabidopsis thaliana
MASGSMSSYGSGSWTVKQNKAFERALAVYDQDTPDRWHNVARAVGGKTPEEAKRQYDLLVRDIESIENGHVPFPDYKTTTGNSNRGRLRDEEKRMRSMKLQ

SEQ ID NO: 361 - DNA, 1484 bp, Arabidopsis thaliana
gaaaaagacttcactttttttttttactaattaattagtttttttttctcctttccaaaacaatggagaatttcgtcgacgagaatggttttgcttctctaaaccaaaacatcttcacacgtgatcaagaacacatgaaagaagaagattttccattcgaagtcgtcgaccaatcaaaacctacaagctttcttcaagattttcaccatcttgatcatgatcatcagtttgatcatcatcatcatcatggctcctcatcttcacatcctttgctcagcgtccaaactacgtcttcttgtatcaataatgctcctttcgagcattgctcttaccaagaaaacatggtcgatttctatgaaactaaaccaaatttgatgaatcatcatcatttccaagcagtggaaaactcatacttcactcgtaatcatcatcatcatcaagagatcaatttggtcgatgaacatgatgatcctatggacttggagcaaaacaacatgatgatgatgaggatgatcccttttgattaccctcctacagagactttcaaacctatgaacttcgtaatgccagatgaaatttcatgtgtttctgcagataatgattgttatagagcaacgagtttcaacaagaccaaaccatttcttacacgaaagttgtcttcttcttcttcatcatcatcatggaaagaaaccaaaaagtcaaccttagtcaaaggacaatggactgctgaagaagacagggtactgattcaactcgtggagaagtatggattgcgtaaatggtcgcatatcgctcaagtgttaccgggaagaatcgggaaacaatgtagagagaggtggcataaccatttgagacctgacattaagaaagaaacatggagtgaagaagaggacagagtgttgatagaatttcacaaagagattggaaacaaatgggcagagattgcgaaaagactcccgggaagaacagagaactcgatcaagaaccattggaacgcaacaaaaagaagacaattctctaaaagaaaatgtagatctaagtatccaagaccttctctgttgcaggattacatcaagagcttgaatatgggagctttgatggcttcttctgttcctgcaagaggtagacgcagagagagtaataacaagaagaaggatgttgttgttgcggttgaggagaagaagaaggaagaggaggtgtatggacaagacaggattgtgcctgaatgtgtgtttactgatgattttggattcaatgagaagctgcttgaggaaggatgtagcattgactctttgcttgatgacattcctcagcctgacattgatgcttttgttcatgggctctgatttgtattttttattctgcttgtttcagttttgttgttttttgtttgtctttttatacgagacagattccaccaaacttcaataatttgaaaagatataaaatattttgctttttaaaaaaaaaaaaaaaaaaaaaaa

SEQ ID NO: 362 - protein, 427 aa, Arabidopsis thaliana
MENFVDENGFASLNQNIFTRDQEHMKEEDFPFEVVDQSKPTSFLQDFHHLDHDHQFDHHHHHGSSSSHPLLSVQTTSSCINNAPFEHCSYQENMVDFYETKPNLMNHHHFQAVENSYFTRNHHHHQEINLVDEHDDPMDLEQNNMMMMRMIPFDYPPTETFKPMNFVMPDEISCVSADNDCYRATSFNKTKPFLTRKLSSSSSSSSWKETKKSTLVKGQWTAEEDRVLIQLVEKYGLRKWSHIAQVLPGRIGKQCRERWHNHLRPDIKKETWSEEEDRVLIEFHKEIGNKWAEIAKRLPGRTENSIKNHWNATKRRQFSKRKCRSKYPRPSLLQDYIKSLNMGALMASSVPARGRRRESNNKKKDVVVAVEEKKKEEEVYGQDRIVPECVFTDDFGFNEKLLEEGCSIDSLLDDIPQPDIDAFVHGL

SEQ ID NO: 363 - DNA, 549 bp, Arabidopsis thaliana
atgtacatgcaaaaacaaaaaccttaaaagctttcatggaacgtatagagtcttataacacgaatgagatgaaatacagaggcgtacgaaagcgtccatggggaaaatatgcggcggagattcgcgactcagctagacacggtgctcgtgtttggcttgggacgtttaacacagcggaagacgcggctcgggcttatgatagagcagctttcggcatgagaggccaaagggccattctcaattttcctcacgagtatcaaatgatgaaggacggtccaaatggcagccacgagaatgcagtggcttcctcgtcgtcgggatatagaggaggaggtggtggtgatgatgggagggaagttattgagttcgagtatttggatgatagtttattggaggagcttttagattatggtgagagatctaaccaagacaattgtaacgacgcaaaccgctagatcatcactacttacttacagtgtaatgtttttggagtaaagagtaataatcaatataatatactttagtttaggaaaaaaaaaaaaaaaaaaa

SEQ ID NO: 364 - protein, 139 aa, Arabidopsis thaliana
MERIESYNTNEMKYRGVRKRPWGKYAAEIRDSARHGARVWLGTFNTAEDAARAYDRAAFGMRGQRAILNFPHEYQMMKDGPNGSHENAVASSSSGYRGGGGGDDGREVIEFEYLDDSLLEELLDYGERSNQDNCNDANR

SEQ ID NO: 365 - DNA, 1818 bp, Arabidopsis thaliana
agtgatttattgattaacccaaacacaaaataaacagatttgactcaaaaagaagaaaatgaattctaacaactggcttggctttcctctttcaccgaacaactcttctttgcctcctcatgaatacaaccttggcttggtcagcgaccatatggacaacccttttcaaacacaagagtggaatatgatcaatccacacggtggaggaggagatgaaggaggagaggttccaaaagtggccgattttctcggtgtgagcaaaccggacgaaaaccaatccaaccacctagtagcttacaacgactcagactactacttccataccaatagcttgatgcctagcgtccaatcaaacgatgtcgttgtagcagcttgtgactccaatactcctaacaacagtagctatcatgagcttcaagagagtgctcacaatctacagtcacttactttgtccatggggaccaccgctggtaataatgttgtagacaaagcttcaccatccgagaccaccggggataacgctagcggtggagcactagccgttgttgagacggccacgccaagacgtgcattggacactttcggacaacgaacctcgatctatcgtggtgtcacaagacatcgatggactggtcgatatgaggctcatctatgggataatagttgtagaagggaaggccagtctaggaaaggaagacaagtttacttgggtggatatgacaaagaagataaagcagcaagatcatatgatctagctgcacttaagtactggggtccttcaactactactaatttccccattacaaactacgagaaagaagtagaggaaatgaagcacatgacgagacaagagttcgtggctgccattagaaggaaaagtagtggattttcgagaggcgcttcgatgtatcgaggagttacaaggcatcaccaacatggaagatggcaagcaaggatcggccgagtcgccggaaacaaagacctctacttgggaacttttagcactgaggaagaagcagcagaagcttacgatatagctgcaataaagtttagaggacttaatgcagtgaccaacttcgagatcaaccggtacgacgtgaaagccattctagagagtagcactcttcccatcggaggaggcgcagctaaacggctcaaagaagctcaagctcttgagtcttcaaggaaacgcgaggcggagatgatagcccttggttcaagtttccagtacggtggtggctcgagcacaggctctggctccacctcatcaagacttcagcttcaaccttaccctctaagcattcaacaaccattagagccttttctatctcttcagaacaatgacatctctcattacaacaacaacaatgctcacgattcctcctcttttaatcaccatagctatatccagacacaacttcatctccaccaacagaccaacaattacttgcagcaacagtcgagccagaactctcagcagctctacaatgcgtatcttcatagcaatccggctctgcttcatggacttgtctctacctctatcgttgacaacaataataacaatggaggctctagtgggagctacaacactgcagcatttcttgggaaccacggtattggtattgggtccagctcgactgttggatcgaccgaggagtttccaaccgttaaaacagattacgatatgccttccagtgatggaaccggagggtatagtggttggaccagtgagtctgttcaggggtcaaaccctggtggtgttttcactatgtggaatgagtaaacaaggatctctttcttgcggcacaaggaatgggt

SEQ ID NO: 366 - protein, 574 aa, Arabidopsis thaliana
MNSNNWLGFPLSPNNSSLPPHEYNLGLVSDHMDNPFQTQEWNMINPHGGGGDEGGEVPKVADFLGVSKPDENQSNHLVAYNDSDYYFHTNSLMPSVQSNDVVVAACDSNTPNNSSYHELQESAHNLQSLTLSMGTTAGNNVVDKASPSETTGDNASGGALAVVETATPRRALDTFGQRTSIYRGVTRHRWTGRYEAHLWDNSCRREGQSRKGRQVYLGGYDKEDKAARSYDLAALKYWGPSTTTNFPITNYEKEVEEMKHMTRQEFVAAIRRKSSGFSRGASMYRGVTRHHQHGRWQARIGRVAGNKDLYLGTFSTEEEAAEAYDIAAIKFRGLNAVTNFEINRYDVKAILESSTLPIGGGAAKRLKEAQALESSRKREAEMIALGSSFQYGGGSSTGSGSTSSRLQLQPYPLSIQQPLEPFLSLQNNDISHYNNNNAHDSSSFNHHSYIQTQLHLHQQTNNYLQQQSSQNSQQLYNAYLHSNPALLHGLVSTSIVDNNNNNGGSSGSYNTAAFLGNHGIGIGSSSTVGSTEEFPTVKTDYDMPSSDGTGGYSGWTSESVQGSNPGGVFTMWNE

SEQ ID NO: 367 - DNA, 450 bp, Arabidopsis thaliana
acaaacacgcaaaaagtcattaatatatggatcaaggaggtcgaggtgtcggtgccgagcatggaaagtaccggggagttcggagacgaccttggggaaaatatgcagcagagatacgagattcgaggaagcacggtgaacgtgtgtggcttggaacgttcgatacggcagaggaagcggctagagcctatgaccaagctgcttactccatgagaggccaagcagcaatccttaacttccctcatgagtataacatggggagtggtgtctcttcttccaccgccatggctggatcttcctccgcctccgcctccgcttcttcttcttctaggcaagtttttgaatttgagtacttggatgatagtgttttggaggagctccttgaggaaggagagaaacctaacaagggcaagaagaaatgagcgagatataattcatgattatttctaa

SEQ ID NO: 368 - protein, 131 aa, Arabidopsis thaliana
MDQGGRGVGAEHGKYRGVRRRPWGKYAAEIRDSRKHGERVWLGTFDTAEEAARAYDQAAYSMRGQAAILNFPHEYNMGSGVSSSTAMAGSSSASASASSSSRQVFEFEYLDDSVLEELLEEGEKPNKGKKK

SEQ ID NO: 369 - DNA, 1107 bp, Arabidopsis thaliana
ccattatcatatcctcttcttccttcttcactatcaatcttcttctccactacaacacaaatggagaaatcatcctcaatgaaacaatggaagaagggtcctgctcggggtaaaggcggtccacaaaacgctctttgtcagtaccgtggagtcaggcaaaggacttggggcaaatgggtggctgagatcagagagcccaagaagagggcaagactttggcttggctctttcgctacagctgaagaagcagctatggcttatgatgaggctgccttgaaactctatgggcacgacgcatacctcaacttacctcatcttcagcggaatacaagaccttctctgagtaactctcagaggttcaaatgggtaccttcaaggaagtttatatctatgtttccttcatgtggtatgctaaacgtgaatgctcagcctagtgttcacataatccagcaaagactagaagaactcaagaaaactggacttttatctcaatcctattcttctagttcttcctccaccgaatcaaaaactaatactagctttcttgatgagaagaccagcaagggagaaacagacaatatgttcgaaggtggtgatcagaagaaaccagagatcgacctgaccgagtttcttcagcaactaggaatcttgaaggatgaaaatgaagcagaaccaagtgaggtagcagagtgtcattcccctccaccatggaacgagcaagaagaaactggaagtcctttcagaactgagaatttcagctgggataccctgatcgagatgccaagaagtgaaaccacaactatgcaatttgactccagcaacttcggaagctatgattttgaggatgatgtatccttcccttccatctgggactactacggaagcttagattgagtaaaagcaatttaaggtagatcaagattcagaagtacacaaatggttttggatttagtgtagcgttttggaaaagagacataggtagtgagagtgcagtcttttattatgcagcaataaagtgagtcagtgtacaaccgagttgttcgctttttttggtatattaatgaagcatgttcattttttcgctaaaaaaaaaaaaaaaaaaaaaaa

SEQ ID NO: 370 - protein, 277 aa, Arabidopsis thaliana
MEKSSSMKQWKKGPARGKGGPQNALCQYRGVRQRTWGKWVAEIREPKKRARLWLGSFATAEEAAMAYDEAALKLYGHDAYLNLPHLQRNTRPSLSNSQRFKWVPSRKFISMFPSCGMLNVNAQPSVHIIQQRLEELKKTGLLSQSYSSSSSSTESKTNTSFLDEKTSKGETDNMFEGGDQKKPEIDLTEFLQQLGILKDENEAEPSEVAECHSPPPWNEQEETGSPFRTENFSWDTLIEMPRSETTTMQFDSSNFGSYDFEDDVSFPSIWDYYGSLD

SEQ ID NO: 371 - DNA, 1356 bp, Arabidopsis thaliana
atgcagagcagcttcaaaaccgttcctttcactcctgatttctactctcaatcctcttacttcttcagaggagatagttgtcttgaggagtttcatcaaccagtcaatggttttcaccatgaagaagctatcgatttaagtccaaatgtcactattgcttcagctaacttacactacacgacgtttgatacggttatggattgtggtggtggtggtggtggcttgagggagagacttgaaggaggagaagaggagtgtttggacacagggcaattagtgtaccagaaagggacaagattagtaggaggaggagtaggagaagtgaacagcagttggtgtgattcggtttcagctatggctgataacagtcaacatactgacacttccacagatattgatactgatgacaagactcagttgaatggaggtcatcaagggatgctattggctacaaattgttcagatcaatccaatgtgaaatctagtgatcaaaggacacttcgtcgacttgctcagaaccgggaggctgctaggaaaagtcggttgaggaaaaaggcctatgttcagcaacttgagaatagtcgaatcaggcttgcacagctagaggaagagctcaaaagagctcgccaacagggatctttggttgaaagaggagtttcagcggatcacacgcatttggcagcaggaaatggtgtcttttcatttgaattggaatatacacgttggaaggaggaacatcaaagaatgatcaacgacttaagatcgggtgtgaattcgcagttaggtgacaacgatctacgcgttctagtggatgctgtgatgagtcactatgatgaaatattcaggctaaagggaattggcactaaagttgaagtctttcatatgctctcaggcatgtggaagacacctgccgagagatttttcatgtggttaggtggatttagatcatcagagttacttaagatattggggaaccatgtggatccattgacggaccagcagttgataggcatttgcaaccttcagcaatcgtctcaacaagcagaggatgcattgtcacaaggcatggaagctctacaacaatcacttctcgagacgctttcttctgcttctatgggtccaaactcttcagcaaatgttgcagattatatgggtcatatggctatggctatgggcaaacttggcactcttgaaaacttccttcgccaggctgatttattgaggcaacaaactctgcaacagcttcacagaattctcaccacacgacaagctgctcgcgcctttttggtcatccacgattatatttctcggcttagagcacttagctctctatggttagccagacctagagactaa

SEQ ID NO: 372 - protein, 451 aa, Arabidopsis thaliana
MQSSFKTVPFTPDFYSQSSYFFRGDSCLEEFHQPVNGFHHEEAIDLSPNVTIASANLHYTTFDTVMDCGGGGGGLRERLEGGEEECLDTGQLVYQKGTRLVGGGVGEVNSSWCDSVSAMADNSQHTDTSTDIDTDDKTQLNGGHQGMLLATNCSDQSNVKSSDQRTLRRLAQNREAARKSRLRKKAYVQQLENSRIRLAQLEEELKRARQQGSLVERGVSADHTHLAAGNGVFSFELEYTRWKEEHQRMINDLRSGVNSQLGDNDLRVLVDAVMSHYDEIFRLKGIGTKVEVFHMLSGMWKTPAERFFMWLGGFRSSELLKILGNHVDPLTDQQLIGICNLQQSSQQAEDALSQGMEALQQSLLETLSSASMGPNSSANVADYMGHMAMAMGKLGTLENFLRQADLLRQQTLQQLHRILTTRQAARAFLVIHDYISRLRALSSLWLARPRD

SEQ ID NO: 373 - DNA, 1087 bp, Arabidopsis thaliana
aaaggagcattggtatctcaaacaatatttgccctttctctatctctctctcatcactatttgccatctctttctctctccctctctttcaaatgtcaataaaccaatactcaagcgatttccactaccattctctcatgtggcaacaacagcagcaacaacaacaacaccaaaacgacgtcgtggaagaaaaagaagctcttttcgagaaacccttaaccccaagtgacgtcggaaaactcaaccgcctcgtcatcccaaaacagcacgccgagagatacttcccactagcggccgccgccgcagacgccgtggagaaaggacttctcctctgctttgaggacgaggaaggtaaaccatggagattcagatactcgtactggaacagtagccagagttatgtcttgaccaaaggctggagcagatacgtcaaggagaagcaccttgacgccggagacgtcgttctcttccatcgacaccgttcagacggcggaagattcttcattggctggagaagacgcggtgactcttcttcctcctccgactcttatcgccatgttcaatccaatgcctcgctccaatattatcctcatgcaggggctcaagcggtggagagccaaagaggcaactcgaagacattaagactgttcggagtgaacatggagtgccagctagattcggactggtccgagccatccacacctgacggttctaacacatatacaaccaatcacgaccagtttcatttctaccctcaacaacaacactatcctcctccgtactacatggacataagtttcacaggagatatgaaccggacgagctagaagcccacaaggattaaaaaaaagcttcacatctggtcctgttatgttgtcatagatgttgattccttaattttacacaagcttcattttgcattatttaaagtaaaatcgtattttgattcttctttaaatctctctcaattttcactctcttcctttttcttcttatgtattagattcttttacatagctaacacttgtatagagaattcaaagttctggctattttcgaaagttatcttttctcttaaaaaaaaaaa

SEQ ID NO: 374 - protein, 244 aa, Arabidopsis thaliana
MSINQYSSDFHYHSLMWQQQQQQQQHQNDVVEEKEALFEKPLTPSDVGKLNRLVIPKQHAERYFPLAAAAADAVEKGLLLCFEDEEGKPWRFRYSYWNSSQSYVLTKGWSRYVKEKHLDAGDVVLFHRHRSDGGRFFIGWRRRGDSSSSSDSYRHVQSNASLQYYPHAGAQAVESQRGNSKTLRLFGVNMECQLDSDWSEPSTPDGSNTYTTNHDQFHFYPQQQHYPPPYYMDISFTGDMNRTS

SEQ ID NO: 375 - DNA, 1454 bp, Arabidopsis thaliana
cgtcgacgatcagattcttgcgtatagctgtatatatacaccaagatacactcatcatcgtcatatatagattatgtgcagcgtctctgagcttcttgacatggaaaacttccaaggagacttaaccgacgtcgtacgaggaatcggaggccacgtgttatcaccggagactcctccctcgaacatctggcctcttcctctgtcacatccaacaccatcaccgtcagatcttaacataaaccccttcggagatccctttgtgagcatggacgatccactcctccaagaactaaactccatcacaaactccggctatttctccaccgtaggagataacaacaacaacattcacaacaacaatggtttcttggttccaaaggtatttgaggaggatcatataaagagtcaatgtagtatcttcccaagaatccggatctcgcatagtaacatcatccacgattcttctccgtgtaattctccggccatgtcggctcacgttgtcgcagccgcagcagccgcctcgccgagaggcatcatcaacgtagacacaaacagtcctagaaactgtctattggttgatggtaccacgttctcctcgcagattcagatatcttcccctcggaatctaggccttaaaagaaggaagagtcaggcaaagaaggtggtgtgtattccggccccggctgcaatgaacagccgatcaagcggagaagtggttccatcggatctatgggcttggcgtaaatacggtcaaaaacctatcaaaggctctccttttccaaggggttattatagatgcagcagctcaaaaggttgttcagcaagaaagcaagtcgaaagaagccgaaccgatccaaacatgttggtgattacatatacctccgaacataaccatccttggcccatccaacgcaacgctctcgccggctccacacgctcctccacctcctcctcatctaaccctaatccttccaaaccctcaaccgcaaacgtaaactcctcatccattggctcccaaaacaccatctacttgccttcctccaccactcctcctcctaccctctcatcctccgccatcaaagatgaacgaggggacgatatggagttggaaaacgtagatgatgatgatgataaccagattgctccatacagaccggagcttcatgatcatcagcaccaaccagatgatttctttgcagatcttgaagagctagaaggagattctctaagcatgttgctttctcatggctgtggcggcgacgggaaggataaaacgaccgcgtccgatgggatcagcaatttcttcgggtggtcgggagataataattataataattacgacgaccaagactcaaggtcgttatagtatagtgttaattacaggtaaacaaattatattaaattaagttgagcttgtgaaaatgaagatcatatggtctggtcaggttgggggc

SEQ ID NO: 376 - protein, 430 aa, Arabidopsis thaliana
MCSVSELLDMENFQGDLTDVVRGIGGHVLSPETPPSNIWPLPLSHPTPSPSDLNINPFGDPFVSMDDPLLQELNSITNSGYFSTVGDNNNNIHNNNGFLVPKVFEEDHIKSQCSIFPRIRISHSNIIHDSSPCNSPAMSAHVVAAAAAASPRGIINVDTNSPRNCLLVDGTTFSSQIQISSPRNLGLKRRKSQAKKVVCIPAPAAMNSRSSGEVVPSDLWAWRKYGQKPIKGSPFPRGYYRCSSSKGCSARKQVERSRTDPNMLVITYTSEHNHPWPIQRNALAGSTRSSTSSSSNPNPSKPSTANVNSSSIGSQNTIYLPSSTTPPPTLSSSAIKDERGDDMELENVDDDDDNQIAPYRPELHDHQHQPDDFFADLEELEGDSLSMLLSHGCGGDGKDKTTASDGISNFFGWSGDNNYNNYDDQDSRSL

SEQ ID NO: 377 - DNA, 969 bp, Arabidopsis thaliana
atgattggaacaagcttccccgaggatcttgattgtggcaacttctttgacaacatggatgatctcatggactttcccggtggagatatcgatgtcggtttcggcataggtgactccgactctttccctaccatctggaccactcatcacgacacgtggcctgccgcttctgatcctctcttctcttccaacaccaactctgattcatcacctgagctctatgttccgtttgaggacattgttaaggtggaaagacctccaagctttgtagaggaaacattggttgagaagaaggaagattcgttttcgacaaacactgattcatcatcttctcatagccaattcaggagctcaagtccagtgtcggttctcgagagcagctcctcctcgtctcaaaccaccaacacaacctcccttgttctccctggaaagcacggtcgtccacgcacaaaacgccctcgtccacctgtccaggataaagatagagtcaaagacaatgtgtgcggtggtgactcgcgcctcatcattagaataccgaaacagtttctctctgatcacaacaagatgatcaacaagaagaagaagaagaaggccaagattacttcttcctcttcttcgtccgggattgatcttgaagtcaatggaaacaacgtcgattcgtattcttcagagcaatatccgcttaggaaatgtatgcactgtgaggtcaccaagactccacagtggaggcttggtccaatgggtccaaagacactttgcaatgcgtgcggtgtacgttacaaatcagggaggcttttcccggagtaccgtccagctgctagtccaacatttactccagctcttcactcaaactcacacaagaaagtggctgaaatgagaaacaagagatgcagtgatggtagctacataaccgaagagaatgatctgcaagggctgattccgaacaatgcctacattggcgtagactaa

SEQ ID NO: 378 - protein, 322 aa, Arabidopsis thaliana
MIGTSFPEDLDCGNFFDNMDDLMDFPGGDIDVGFGIGDSDSFPTIWTTHHDTWPAASDPLFSSNTNSDSSPELYVPFEDIVKVERPPSFVEETLVEKKEDSFSTNTDSSSSHSQFRSSSPVSVLESSSSSSQTTNTTSLVLPGKHGRPRTKRPRPPVQDKDRVKDNVCGGDSRLIIRIPKQFLSDHNKMINKKKKKKAKITSSSSSSGIDLEVNGNNVDSYSSEQYPLRKCMHCEVTKTPQWRLGPMGPKTLCNACGVRYKSGRLFPEYRPAASPTFTPALHSNSHKKVAEMRNKRCSDGSYITEENDLQGLIPNNAYIGVD

SEQ ID NO: 379 - DNA, 668 bp, Arabidopsis thaliana
ataacaagcctagaacactagaaacttcaaaaaagaaaaaaatcttatggagaacaacaacggcaacaaccagctgccaccgaaaggtaacgagcaactgaagagtttctggtcaaaagagatggaaggtaacttagatttcaaaaatcacgaccttcctataactcgtatcaagaagattatgaagtatgatccggatgtgactatgatagctagtgaggctccaatcctcctctcgaaagcatgtgagatgtttatcatggatctcacgatgcgttcgtggctccatgctcaggaaagcaaacgagtcacgctacagaaatctaatgtcgatgccgcagtggctcaaactgttatctttgatttcttgcttgatgatgacattgaggtaaagagagagtctgttgccgccgctgctgatcctgtggccatgccacctattgacgatggagagctgcctccaggaatggtaattggaactcctgtttgttgtagtcttggaatccaccaaccacaaccacaaatgcaggcatggcctggagcttggacctcggtgtctggtgaggaggaagaagcgcgtgggaaaaaaggaggtgacgacggaaactaataagtggaatacgttttagggtattttcaagggaatatgtagtaaatagtcatggatc

SEQ ID NO: 380 - protein, 187 aa, Arabidopsis thaliana
MENNNGNNQLPPKGNEQLKSFWSKEMEGNLDFKNHDLPITRIKKIMKYDPDVTMIASEAPILLSKACEMFIMDLTMRSWLHAQESKRVTLQKSNVDAAVAQTVIFDFLLDDDIEVKRESVAAAADPVAMPPIDDGELPPGMVIGTPVCCSLGIHQPQPQMQAWPGAWTSVSGEEEEARGKKGGDDGN

SEQ ID NO: 381 - DNA, 1941 bp, Arabidopsis thaliana
ttccttggcattctctttagaactttcgtacaaaatgcaaaacctgaacctctaaagctaaaaaaaaagattagagactgtaactgcttttatcagattttcaactaggaaaaaagttacaatcttttttgatggctcctccaatgacgaattgcttaacgttttctctgtcaccaatggagatgttgaaatcaactgatcagtctcacttctcttcttcttacgacgattcttctactccttatctcatcgataacttctatgctttcaaagaagaagctgagatagaagctgctgctgcttcaatggcggattcaacaaccttatctacttttttcgatcattctcagactcagattccaaagctggaagatttcctcggtgattcctttgtccgttactctgataaccaaacagagacccaagactcttcttctctcactccattctacgatccacgtcaccgcaccgttgccgaaggagttacagggttcttctctgatcatcatcagccagatttcaagacgataaactcgggaccagaaatcttcgatgactcaacaacttccaacatcggtggtactcatctctccagtcacgtggtggagtcatcaacgacggcgaagttagggtttaacggtgattgcaccaccaccggaggagttttgtctctaggggttaacaacacatcagatcaacctttgagctgtaacaatggcgagagaggtggaaacagtaacaagaagaaaacagtttctaagaaggaaacatcagatgattcaaagaagaagattgtcgaaacattgggacaaagaacttcaatttatcgtggagtcacccgacatagatggactggaagatacgaagcgcatctatgggataacagctgtaggagggaaggtcaagccagaaaaggacgtcaagtgtacttaggtggatatgacaaggaagatagagcagctagagcctatgacttggcagctttaaaatactggggttctactgctactacaaattttccggtctcgagttattcaaaagaacttgaggaaatgaatcacatgaccaagcaagagtttattgcatctcttaggaggaaaagtagcggtttttcgagaggagcttcaatatatagaggtgtcacaaggcatcatcaacaaggtcgctggcaagcaagaatcggccgtgtcgcaggaaacaaagatctttacctcggaacctttgcaaccgaagaggaagcagcagaggcttatgacattgcagccataaagttcagaggaatcaacgcagtaactaactttgagatgaacaggtatgacattgaagctgtcatgaatagttctttacctgtaggaggagcagctgcgaaacgccacaaactcaaactcgctcttgaatctccttcttcatcatcctctgaccataacctccaacaacaacagttgcttccgtcctcttctccctcggatcaaaaccctaactcaatcccatgtggcattccatttgagccttcagttctctattaccaccagaacttctttcagcattatcctttggtctctgactctacaattcaagctcctatgaaccaagctgagtttttcttgtggcctaaccagtcttactaaatcatttggttcgttcttgcttagacttctattcaccgcactaaccgatgacccgaggcttatcttcttgattctggctataaggatgaatctttcaagttccttttttaactgtaggctaagacagaagtagaggggagaaaagttgaagaatctgaaacttttggggtcaattttgtattaatgtttttcttttgtcaagggtggattatcggttttattacttattttttgaatgtaatcggcctataacggtataactctgtttccatttatgaatatttttctcaaattgaaaaaaaaaaaaaaaaaa

SEQ ID NO: 382 - protein, 498 aa, Arabidopsis thaliana
MAPPMTNCLTFSLSPMEMLKSTDQSHFSSSYDDSSTPYLIDNFYAFKEEAEIEAAAASMADSTTLSTFFDHSQTQIPKLEDFLGDSFVRYSDNQTETQDSSSLTPFYDPRHRTVAEGVTGFFSDHHQPDFKTINSGPEIFDDSTTSNIGGTHLSSHVVESSTTAKLGFNGDCTTTGGVLSLGVNNTSDQPLSCNNGERGGNSNKKKTVSKKETSDDSKKKIVETLGQRTSIYRGVTRHRWTGRYEAHLWDNSCRREGQARKGRQVYLGGYDKEDRAARAYDLAALKYWGSTATTNFPVSSYSKELEEMNHMTKQEFIASLRRKSSGFSRGASIYRGVTRHHQQGRWQARIGRVAGNKDLYLGTFATEEEAAEAYDIAAIKFRGINAVTNFEMNRYDIEAVMNSSLPVGGAAAKRHKLKLALESPSSSSSDHNLQQQQLLPSSSPSDQNPNSIPCGIPFEPSVLYYHQNFFQHYPLVSDSTIQAPMNQAEFFLWPNQSY

SEQ ID NO: 383 - DNA, 818 bp, Arabidopsis thaliana
cagacatcacaatcaaattaggtcagaagaattagtcggagaaaacagccatgggaagaagaaaagtagagatcaaacgaattgagaacaaaagctctcgacaagttactttctgtaaacgacgaaatggtctcatggagaaagctcgtcaactctcaattctttgtgaatcctccgtcgctcttatcatcatctctgccaccggaagactctacagcttctcctcaggtgatagcatggccaagatcctcagtcgttatgaattagaacaggctgatgatcttaaaaccttggatctagaagaaaaaactcttaattatctttcgcacaaggagttgctagaaacaatccaatgcaagattgaagaagcgaaaagcgataatgtaagtatagattgtctaaagtccctggaagagcagctcaagactgctctgtctgtaactagagctaggaagacagaactaatgatggagcttgtgaagacccatcaagagaaggagaagctgctgagagaggagaaccagagtttgactaaccagcttataaagatggggaagatgaagaagtctgtggaagcagaggatgcaagagcaatgtcaccggaaagtagctctgacaacaagccaccggagactctcctgcttctcaagtaaccaccatcaccaacgactgattcgaaaaataaaaattgtaaaaattatgatttgtagttcataaggaaagctacatactgtatgttaaaaatcctcttcttccccctgctacggaaaagtcatccaaggagatgcatcaaataaagtaattgatttttattgtta

SEQ ID NO: 384 - protein, 200 aa, Arabidopsis thaliana
MGRRKVEIKRIENKSSRQVTFCKRRNGLMEKARQLSILCESSVALIIISATGRLYSFSSGDSMAKILSRYELEQADDLKTLDLEEKTLNYLSHKELLETIQCKIEEAKSDNVSIDCLKSLEEQLKTALSVTRARKTELMMELVKTHQEKEKLLREENQSLTNQLIKMGKMKKSVEAEDARAMSPESSSDNKPPETLLLLK

SEQ ID NO: 385 - DNA, 1860 bp, Arabidopsis thaliana
atgagaggttcttggtacaagagtgtttcctctgtttttggtctcagaccacggatcagagggttgttattcttcattgttggtgttgtggctctagttactattttagcaccattgacatctaattcgtatgattcttcgtcaagttcgacacttgtgccgaacatttatagtaactataggaggataaaggagcaagctgctgttgattatcttgatctgaggtctctttctttaggggctagtttaaaagagtttcctttttgtggtaaagaaagagaaagttatgtgccttgttataacataactgggaatttgcttgctgggcttcaagagggtgaggagttagatcgacattgcgagtttgaaagagagaaggaaagatgtgtagttcgtcctccgagagattataaaataccacttaggtggccacttggtagagatatcatatggagtgggaacgtgaagattaccaaagaccagtttctttcttcaggaactgtgacaacgaggttaatgttgcttgaagagaatcaaataacctttcactcggaggacggcctggtctttgatggggtcaaagactatgctcgtcaaattgctgagatgataggtttaggaagtgatactgaatttgctcaagcgggtgtacggactgtgttagacattggttgcggatttggtagctttggtgctcatttagtgtctttgaagctgatgcctatatgtattgctgagtatgaggcaactgggagccaagttcagttagctctagagagaggccttcctgcaatgattggcaatttcttttcaaaacagcttccttatccagcactgtcttttgatatggtccattgtgctcaatgtggcactacttgggatatcaaagatgcaatgctacttttggaagtggatcgtgttctgaaacccgggggatactttgttttaacttctcccacaaacaaagcacagggaaacttaccagataccaagaaaacgagcatctcaacacgggtgaatgagttatctaagaaaatctgttggagtctaacagctcagcaggatgagacgtttctttggcagaaaacttctgattcaagttgctattcttctcgttcgcaagcttctatacctctttgcaaagatggagatagcgttccgtattaccacccattggttccatgtataagcggaaccacgagtaaacgctggatttctatacagaacaggtctgctgttgcaggaacaacctctgccgggcttgaaattcatggtttaaaaccggaagaattcttcgaggatacacaaatatggagatcagctctgaaaaactattggtccttgcttacacctctaattttctctgaccatccgaagagacccggtgatgaggatcctctcccgcctttcaacatgatacgcaatgtgatggacatgcatgctcgttttgggaatttaaatgccgctttactcgacgaaggaaaatctgcttgggtaatgaacgtcgtcccagtcaatgcacgtaatactcttcctatcatacttgatcgtggtttcgccggtgttctacatgactggtgtgaaccattcccgacatatcctcgaacatatgacatgcttcatgccaatgaacttctcacacatcttagctcagaacgatgcagcctaatggacttgttcttggagatggaccggattcttcgccctgagggatgggttgttctaagcgacaaagtgggagtaatcgagatggctcgagcacttgcagctcgagtgcgttgggaagcaagagtcattgatcttcaagatggtagtgaccaaagacttctcgtctgtcaaaaaccattcatcaaaaaataa

SEQ ID NO: 386 - protein, 619 aa, Arabidopsis thaliana
MRGSWYKSVSSVFGLRPRIRGLLFFIVGVVALVTILAPLTSNSYDSSSSSTLVPNIYSNYRRIKEQAAVDYLDLRSLSLGASLKEFPFCGKERESYVPCYNITGNLLAGLQEGEELDRHCEFEREKERCVVRPPRDYKIPLRWPLGRDIIWSGNVKITKDQFLSSGTVTTRLMLLEENQITFHSEDGLVFDGVKDYARQIAEMIGLGSDTEFAQAGVRTVLDIGCGFGSFGAHLVSLKLMPICIAEYEATGSQVQLALERGLPAMIGNFFSKQLPYPALSFDMVHCAQCGTTWDIKDAMLLLEVDRVLKPGGYFVLTSPTNKAQGNLPDTKKTSISTRVNELSKKICWSLTAQQDETFLWQKTSDSSCYSSRSQASIPLCKDGDSVPYYHPLVPCISGTTSKRWISIQNRSAVAGTTSAGLEIHGLKPEEFFEDTQIWRSALKNYWSLLTPLIFSDHPKRPGDEDPLPPFNMIRNVMDMHARFGNLNAALLDEGKSAWVMNVVPVNARNTLPIILDRGFAGVLHDWCEPFPTYPRTYDMLHANELLTHLSSERCSLMDLFLEMDRILRPEGWVVLSDKVGVIEMARALAARVRWEARVIDLQDGSDQRLLVCQKPFIKK

SEQ ID NO: 387 - DNA, 1902 bp, Arabidopsis thaliana
atggcgaaagagaacagtggtcatcatcaccaaacagaagcaagaagaaagaaactaactttgattcttggtgtaagtggactctgcattttgttctatgttttaggtgcatggcaagccaataccgtcccatcttctatctcgaagctcggatgcgagacgcaatcaaacccttcttcgtcctcttcctcttcctcatcttcagagtcagctgaactagatttcaaaagccataatcagattgagttaaaggaaacaaaccaaaccattaagtactttgaaccatgtgaattatctctcagtgagtacactccttgtgaagaccgacaaagaggaagaagattcgataggaacatgatgaaatatagagaaagacattgtcctgtaaaagatgagcttctttattgtttgattcctcctccaccaaactacaagattccatttaaatggccacaaagtagagactatgcttggtatgacaatatccctcacaaggaacttagtgttgagaaagcagttcaaaactggattcaagttgaaggtgaccgctttagattccctggtggtggtactatgtttcctcgtggagctgatgcttatatcgatgatattgctaggcttattcctcttactgatggtggaatcagaacagctattgacactggatgtggtgttgcaagttttggtgcttacctcttgaagagagacattatggctgtgtcttttgctccaagagacactcatgaagctcaggtacagtttgctttagaacgcggagttcctgcgataatcgggattatgggatcaagaagacttccttatccagctagagcttttgatcttgctcattgttctcgttgtttgatcccttggtttaaaaatgatggtttgtaccttatggaggtcgaccgggttttaagaccgggcggttactggatcctctcgggaccaccgattaactggaaacagtactggagagggtgggagagaacagaggaggatttgaagaaagagcaagattcaatagaagatgtagcaaagagtctttgctggaagaaagtaactgaaaaaggtgacttatcaatttggcaaaagcctctcaatcacattgagtgtaaaaagctcaaacaaaacaataagtcacctccgatatgcagctcagataacgcggattccgcttggtacaaagacttggaaacttgtataacaccattaccagaaacaaacaatccagatgattcagcaggcggtgcactcgaggattggccagaccgagcattcgcggtacctccaagaatcatcagaggaactataccagaaatgaacgcggagaaatttagagaagacaacgaggtttggaaagagagaatagcacattacaagaagatagtccctgagctttcacatggaagattcaggaacattatggacatgaacgcttttctcggcggattcgctgcttccatgctgaaatatccctcatgggtcatgaacgttgtcccggtcgatgcagagaaacaaacgttaggtgtgatctacgaacgtggattgatagggacgtatcaagattggtgtgaaggattctcaacgtatccaagaacttatgatatgattcatgcaggaggattgttcagcttatacgaacataggtgtgatttgacgttgatattgttggagatggatcgaattttgagaccagaaggaacagttgtgttgagagataatgtggagacgttgaataaggtagagaagatagtgaagggaatgaagtggaagagtcaaattgttgatcatgagaaaggtccttttaatcctgagaagattcttgttgctgttaaaacttattggactggtcaaccttctgacaagaacaacaacaacaacaacaacaacaacaactag

SEQ ID NO: 388 - protein, 633 aa, Arabidopsis thaliana
MAKENSGHHHQTEARRKKLTLILGVSGLCILFYVLGAWQANTVPSSISKLGCETQSNPSSSSSSSSSSESAELDFKSHNQIELKETNQTIKYFEPCELSLSEYTPCEDRQRGRRFDRNMMKYRERHCPVKDELLYCLIPPPPNYKIPFKWPQSRDYAWYDNIPHKELSVEKAVQNWIQVEGDRFRFPGGGTMFPRGADAYIDDIARLIPLTDGGIRTAIDTGCGVASFGAYLLKRDIMAVSFAPRDTHEAQVQFALERGVPAIIGIMGSRRLPYPARAFDLAHCSRCLIPWFKNDGLYLMEVDRVLRPGGYWILSGPPINWKQYWRGWERTEEDLKKEQDSIEDVAKSLCWKKVTEKGDLSIWQKPLNHIECKKLKQNNKSPPICSSDNADSAWYKDLETCITPLPETNNPDDSAGGALEDWPDRAFAVPPRIIRGTIPEMNAEKFREDNEVWKERIAHYKKIVPELSHGRFRNIMDMNAFLGGFAASMLKYPSWVMNVVPVDAEKQTLGVIYERGLIGTYQDWCEGFSTYPRTYDMIHAGGLFSLYEHRCDLTLILLEMDRILRPEGTVVLRDNVETLNKVEKIVKGMKWKSQIVDHEKGPFNPEKILVAVKTYWTGQPSDKNNNNNNNNNN

SEQ ID NO: 389 - DNA, 1136 bp, Arabidopsis thaliana
tagacctcttaggaaaaaaacctaaaaacctaatccccaaacctaaaaggcttatctcatctcttcttctttgtcttctttactctttttttacctctctcttcattgttcttcaccatgtctaatgaaaccagagatctctacaactaccaatacccttcatcgttttcgttgcacgaaatgatgaatctgcctacttcaaatccatcttcttatggaaacctcccatcacaaaacggttttaatccatctacttattccttcaccgattgtctccaaagttctccagcagcgtatgaatctctacttcagaaaacttttggtctttctccctcttcctcagaggttttcaattcttcgatcgatcaagaaccgaaccgtgatgttactaatgacgtaatcaatggtggtgcatgcaacgagactgaaactagggtttctccttctaattcttcctctagtgaggctgatcaccccggtgaagattccggtaagagccggaggaaacgagagttagtcggtgaagaagatcaaatttccaaaaaagttgggaaaacgaaaaagactgaggtgaagaaacaaagagagccacgagtctcgtttatgactaaaagtgaagttgatcatcttgaagatggttatagatggagaaaatacggccaaaaggctgtaaaaaatagcccttatccaaggagttactatagatgtacaacacaaaagtgcaacgtgaagaaacgagtggagagatcgttccaagatccaacggttgtgattacaacttacgagggtcaacacaaccacccgattccgactaatcttcgaggaagttctgccgcggctgctatgttctccgcagacctcatgactccaagaagctttgcacatgatatgtttaggacggcagcttatactaacggcggttctgtggcggcggctttggattatggatatggacaaagtggttatggtagtgtgaattcaaaccctagttctcaccaagtgtatcatcaagggggtgagtatgagctcttgagggagatttttccttcaattttctttaagcaagagccttgatcgatcattgttataactacatatattatatatattgagagagagaggtagagaaaaaaaaa

SEQ ID NO: 390 - protein, 318 aa, Arabidopsis thaliana
MSNETRDLYNYQYPSSFSLHEMMNLPTSNPSSYGNLPSQNGFNPSTYSFTDCLQSSPAAYESLLQKTFGLSPSSSEVFNSSIDQEPNRDVTNDVINGGACNETETRVSPSNSSSSEADHPGEDSGKSRRKRELVGEEDQISKKVGKTKKTEVKKQREPRVSFMTKSEVDHLEDGYRWRKYGQKAVKNSPYPRSYYRCTTQKCNVKKRVERSFQDPTVVITTYEGQHNHPIPTNLRGSSAAAAMFSADLMTPRSFAHDMFRTAAYTNGGSVAAALDYGYGQSGYGSVNSNPSSHQVYHQGGEYELLREIFPSIFFKQEP

SEQ ID NO: 391 - DNA, 519 bp, Arabidopsis thaliana
atgcgaattttgtgtgatgcttgtgagagcgccgccgctatcgtcttttgcgccgccgacgaagctgccctctgttgctcctgcgacgaaaaagttcataagtgcaacaagctggctagtcggcatcttcgtgtaggcttagctgatccgagtaatgcaccaagctgtgacatatgcgaaaatgcacccgcattcttttactgtgagatagatggtagttccctttgtctacaatgtgatatggtggtacatgttggtgggaagagaacacataggcggtttctattactgagacagagaattgagtttccaggcgataagcctaatcatgctgaccaactgggactacggtgtcaaaaggcttcctctggtcgtggtcaagaatcaaatgggaatggtgatcatgatcataatatgatcgatcttaactccaatcctcaaagagtacacgagcctggatcacataaccaagaggagggtattgatgtaaataacgcaaacaatcacgagcatgaatag

SEQ ID NO: 392 - protein, 172 aa, Arabidopsis thaliana
MRILCDACESAAAIVFCAADEAALCCSCDEKVHKCNKLASRHLRVGLADPSNAPSCDICENAPAFFYCEIDGSSLCLQCDMVVHVGGKRTHRRFLLLRQRIEFPGDKPNHADQLGLRCQKASSGRGQESNGNGDHDHNMIDLNSNPQRVHEPGSHNQEEGIDVNNANNHEHE

SEQ ID NO: 393 - DNA, 1200 bp, Arabidopsis thaliana
atggttttttcttcatttcctacttatcctgatcattcatcaaactggcaacaacaacatcaaccaatcacaaccaccgttggattcacgggaaataacatcaaccaacagtttcttcctcaccatcccctcccaccgcaacagcaacaaacgcctccgcagcttcaccacaacaacggtaacggcggagtcgctgttcccggtggacctggcgggttaatccgaccaggttcgatggcggaaagagcaaggctagccaacataccattacctgaaacagccttgaagtgtccaagatgtgactcaactaacaccaaattctgttacttcaacaactacagtctcactcaacctcgccacttctgcaaagcatgccgtcgttactggacacgtggcggtgctctaaggagcgttcccgtcggtggcggttgccgtagaaacaaaagaaccaaaaacagcagcggtggaggtggcggtagcaccagtagcggtaacagcaagtcacaagacagcgccacgagcaacgaccaataccaccaccgagccatggctaacaatcagatgggaccaccttcttcgtcatcgtctctaagctcgttgctgtcttcttacaacgcagggttaatccccggacatgatcataacagcaataacaacaacatacttggacttggatcatctttgcctcctcttaagcttatgcctcctttagacttcacagacaacttcaccttacaatacggtgccgtttcagctccttcttatcatataggcggtggaagcagtggaggagcggcggctcttttaaacggttttgaccagtggagattcccggcaacaaaccaacttcctttaggcggtttagacccgtttgatcaacaacatcaaatggagcagcagaatccaggttacggattggttaccgggtcgggtcagtatcgacctaagaacattttccataaccttatctcctcttcttcgtctgcttcatcagctatggttacagccaccgcgtcgcaattagcttcagtgaaaatggaagatagtaacaatcagctcaacttgtctagacaactttttggagacgaacaacagctctggaatattcatggcgctgctgcagcatccaccgcagctgcaacaagttcgtggagtgaagtctctaataatttcagttcttcttctactagcaatatataa

SEQ ID NO: 394 - protein, 399 aa, Arabidopsis thaliana
MVFSSFPTYPDHSSNWQQQHQPITTTVGFTGNNINQQFLPHHPLPPQQQQTPPQLHHNNGNGGVAVPGGPGGLIRPGSMAERARLANIPLPETALKCPRCDSTNTKFCYFNNYSLTQPRHFCKACRRYWTRGGALRSVPVGGGCRRNKRTKNSSGGGGGSTSSGNSKSQDSATSNDQYHHRAMANNQMGPPSSSSSLSSLLSSYNAGLIPGHDHNSNNNNILGLGSSLPPLKLMPPLDFTDNFTLQYGAVSAPSYHIGGGSSGGAAALLNGFDQWRFPATNQLPLGGLDPFDQQHQMEQQNPGYGLVTGSGQYRPKNIFHNLISSSSSASSAMVTATASQLASVKMEDSNNQLNLSRQLFGDEQQLWNIHGAAAASTAAATSSWSEVSNNFSSSSTSNI

SEQ ID NO: 395 - DNA, 1110 bp, Arabidopsis thaliana
atggacgctacgaagtggacacagggttttcaagaaatgatgaacgttaaaccaatggagcagatcatgattcctaataacaacacacatcaaccaaacaccacatccaatgcaaggccaaacaccattctcacatctaacggcgtctcaactgctggagcaaccgtctccggcgtaagcaacaacaataacaatacggcggttgtggcggagaggaaagcaagaccacaagagaaactaaattgtccaagatgcaactcaaccaacacaaagttttgttactacaacaactatagtctcacacaaccaagatacttctgcaaaggttgtcgaaggtattggaccgaaggtggatctcttaggaatgttcctgtgggaggaagctcaagaaagaacaagagatcatcttcatcttcttcatcaaacatccttcagacaataccatcttcacttccagatctaaacccgccaatactcttctcaaaccaaatccataataaatcgaaagggtcatcacaagatctcaacttgttgtctttcccagtcatgcaagatcaacatcatcatcatgtccatatgtctcagtttcttcagatgcctaagatggagggaaatggtaacataactcatcagcagcagccttcatcatcttcttctgtctatggttcctcgtcgtctcctgtttcagctcttgaacttttaagaaccggagttaatgtttcttcaagatcagggattaactcatcgttcatgccttccggttcaatgatggattcaaacactgtgctttacacttcttcagggtttccaacaatggtggattacaagccaagtaatctctccttctctaccgatcatcaagggcttggacacaatagcaacaataggtctgaagctcttcatagtgatcatcaccaacaaggtagagttttgtttccatttggggatcaaatgaaggagctttcatcaagcataacacaagaagttgatcatgatgataatcaacaacagaagagtcatggaaataataataataataataactcaagccctaataatggatattggagtgggatgttcagtactacaggaggaggatcttcatggtga

SEQ ID NO: 396 - protein, 369 aa, Arabidopsis thaliana
MDATKWTQGFQEMMNVKPMEQIMIPNNNTHQPNTTSNARPNTILTSNGVSTAGATVSGVSNNNNNTAVVAERKARPQEKLNCPRCNSTNTKFCYYNNYSLTQPRYFCKGCRRYWTEGGSLRNVPVGGSSRKNKRSSSSSSSNILQTIPSSLPDLNPPILFSNQIHNKSKGSSQDLNLLSFPVMQDQHHHHVHMSQFLQMPKMEGNGNITHQQQPSSSSSVYGSSSSPVSALELLRTGVNVSSRSGINSSFMPSGSMMDSNTVLYTSSGFPTMVDYKPSNLSFSTDHQGLGHNSNNRSEALHSDHHQQGRVLFPFGDQMKELSSSITQEVDHDDNQQQKSHGNNNNNNNSSPNNGYWSGMFSTTGGGSSW

SEQ ID NO: 397 - DNA, 741 bp, Arabidopsis thaliana
atgatgacgtcatcccatcagagcaacaccaccggctttaaaccgcggcggatcaagacgacggcgaagccaccacgtcagatcaataacaaagaaccatctccggcgacgcagccggtgctcaagtgtccgagatgtgattcagtcaacaccaaattctgctactacaacaactacagcttgtctcagccacgtcactactgcaagaactgtcgtcgttactggacacgtggcggcgccctccgtaacgttcccatcggtggctccactcgaaacaagaacaagccttgcagcctccaagtcatctcttctcctcctttgttctcgaacgggacgtcatcggcgtctcgtgagcttgtaagaaaccatccatcgacggcaatgatgatgatgagttctggtggattctccggctatatgtttccgttggatcctaacttcaaccttgcctcgtcttctatcgagtctttgagttcttttaaccaagatttgcaccagaagcttcagcaacaaagactcgtcacttccatgtttctccaagattctcttccggttaacgagaaaacggttatgtttcagaacgtagagttgattcctccttcgacggtgacgacggattgggttttcgataggttcgccactggaggaggtgcaacaagtggcaatcatgaagataatgatgatggggagggtaatttgggaaattggttccataatgctaataataatgctctgctctaa

SEQ ID NO: 398 - protein, 246 aa, Arabidopsis thaliana
MMTSSHQSNTTGFKPRRIKTTAKPPRQINNKEPSPATQPVLKCPRCDSVNTKFCYYNNYSLSQPRHYCKNCRRYWTRGGALRNVPIGGSTRNKNKPCSLQVISSPPLFSNGTSSASRELVRNHPSTAMMMMSSGGFSGYMFPLDPNFNLASSSIESLSSFNQDLHQKLQQQRLVTSMFLQDSLPVNEKTVMFQNVELIPPSTVTTDWVFDRFATGGGATSGNHEDNDDGEGNLGNWFHNANNNALL

SEQ ID NO: 399 - DNA, 750 bp, Arabidopsis thaliana
atggataacttgaatgttttcgcaaatgaagacaatcaagtgaatgatgtgaagcccccaccaccaccacctcgagtgtgtgcaaggtgtgattctgataatactaaattttgttattacaacaactactgtgagtttcagccacgatacttctgcaagaactgtcgtagatactggactcatggtggggctttaagaaacataccaattggtggaagtagtcgtgccaaacgggcaagggtaaatcaaccttcggttgctcggatggtttctgttgagacccaacgaggtaacaatcaacctttctctaatgttcaagaaaacgttcatcttgttggatcttttggtgcttcatcttcatcttctgttggtgctgttgggaacctttttggttctttgtatgatattcatggtggtatggtaacaaatttgcatccaactcgaactgttcgaccaaatcatcgcttagctttccatgatggatcatttgagcaagactattacgatgttgggtccgataatcttttggtcaaccaacaagttggtggctacggttatcacatgaatccagtggatcaattcaagtggaaccagagcttcaacaacactatgaacatgaattataataacgatagcactagtggaagtagcagaggatctgacatgaatgtgaaccatgataacaagaagatcagataccgcaactctgtgattatgcatccttgtcatctggagaaggatggtccttga

SEQ ID NO: 400 - protein, 249 aa, Arabidopsis thaliana
MDNLNVFANEDNQVNDVKPPPPPPRVCARCDSDNTKFCYYNNYCEFQPRYFCKNCRRYWTHGGALRNIPIGGSSRAKRARVNQPSVARMVSVETQRGNNQPFSNVQENVHLVGSFGASSSSSVGAVGNLFGSLYDIHGGMVTNLHPTRTVRPNHRLAFHDGSFEQDYYDVGSDNLLVNQQVGGYGYHMNPVDQFKWNQSFNNTMNMNYNNDSTSGSSRGSDMNVNHDNKKIRYRNSVIMHPCHLEKDGP

SEQ ID NO: 401 - DNA, 951 bp, Arabidopsis thaliana
atgtcctcccataccaatctcccctctcccaaaccagttcctaaaccagatcaccgtatctccggtacatcccaaaccaagaaaccaccgtcttcctccgtagctcaagaccaacaaaacctaaaatgccctcgttgcaactctccaaacacaaagttctgttactacaacaactacagtctctctcaacctcgtcacttctgcaaatcttgtcgccgttactggacacgtggcggtgctctaagaaacgtccccatcggtggtggttgccggaaaaccaaaaaatctatcaaacctaattcctccatgaacacacttccttcgtcttcttcctctcagaggttcttctcatcaatcatggaagattcatccaaattcttccctcctccgacaacaatggattttcagctggccggattatctctcaacaaaatgaacgatcttcaacttttgaataaccaagaagttcttgatcttaggcccatgatgtcctcgggccgagaaaacacacccgttgatgtcgggtcgggtttatccctaatgggttttggagatttcaacaacaaccattcaccgacggggttcacaaccgccggagcaagcgacggaaacttagcttcttctatagagactttgagttgtttaaaccaagatttacactggaggcttcagcaacagaggatggcgatgctttttggtaattctaaggaagaaactgttgtcgtcgagaggccacaacctattctttatcggaatcttgagatcgtaaactcatcatcgccgtcgtcgccgacgaagaaaggagataatcagacagagtggtattttggtaataacagtgataatgaaggagtgattagtaataatgctaatacaggaggaggaggaagtgaatggaacaatggaattcaagcttggactgatcttaatcattataatgcattgccttga

SEQ ID NO: 402 - protein, 316 aa, Arabidopsis thaliana
MSSHTNLPSPKPVPKPDHRISGTSQTKKPPSSSVAQDQQNLKCPRCNSPNTKFCYYNNYSLSQPRHFCKSCRRYWTRGGALRNVPIGGGCRKTKKSIKPNSSMNTLPSSSSSQRFFSSIMEDSSKFFPPPTTMDFQLAGLSLNKMNDLQLLNNQEVLDLRPMMSSGRENTPVDVGSGLSLMGFGDFNNNHSPTGFTTAGASDGNLASSIETLSCLNQDLHWRLQQQRMAMLFGNSKEETVVVERPQPILYRNLEIVNSSSPSSPTKKGDNQTEWYFGNNSDNEGVISNNANTGGGGSEWNNGIQAWTDLNHYNALP

SEQ ID NO: 403 - DNA, 630 bp, Arabidopsis thaliana
atgccgtcggaaccaaaccaaacccgacccaccagagttcagccctcaacggcggcttacccaccgccaaatctggctgagcctcttccttgtcctcgctgcaactccaccaccaccaagttctgttactacaacaactataacctcgctcagcctcgctactactgcaaatcttgccgccgttactggactcaaggtggtacactccgtgacgtccccgtcggtggtggaactcgtcgaagctcctcaaaacgtcaccgttctttctccaccactgccacctcctcttcctcctcttcttccgtcatcaccaccacgacacaagaaccagccacgactgaagcgagtcaaactaaggttactaatttaatttcaggtcatggaagctttgcttctctgttaggtttaggaagtggaaatggtgggttggattacgggtttgggtacgggtacgggcttgaggagatgagtattgggtatcttggagattcttccgtaggagagattccggtggttgatggttgtggtggtgacacgtggcagattggggagattgaaggtaaaagtggaggagacagtttgatatggcctggtcttgagatctcaatgcaaaccaacgatgttaagtga

SEQ ID NO: 404 - protein, 209 aa, Arabidopsis thaliana
MPSEPNQTRPTRVQPSTAAYPPPNLAEPLPCPRCNSTTTKFCYYNNYNLAQPRYYCKSCRRYWTQGGTLRDVPVGGGTRRSSSKRHRSFSTTATSSSSSSSVITTTTQEPATTEASQTKVTNLISGHGSFASLLGLGSGNGGLDYGFGYGYGLEEMSIGYLGDSSVGEIPVVDGCGGDTWQIGEIEGKSGGDSLIWPGLEISMQTNDVK

SEQ ID NO: 405 - DNA, 615 bp, Arabidopsis thaliana
atgcaggatccagcagcatattaccagacgatgatggcgaagcaacaacaacaacaacaaccacagtttgcagagcaagaacagttaaagtgtcctcgttgtgactcaccaaacactaaattctgttactacaacaactacaatctctcacagcctcgtcacttttgcaaaagctgtcgtcgttactggactaaaggcggcgctctccgtaacgttcccgtcggtggtggttctcgtaagaacgcaaccaaacgatccacttcttcttcttcttctgcttcctctccttccaacagtagccaaaacaagaagacgaaaaacccggatccggatcctgatccacgtaattctcaaaaaccggatttggatccgacccggatgctttacgggtttccgatcggtgaccaagacgtgaagggtatggagattggtggaagctttagctcgttgttggcgaataatatgcagcttggtcttggaggaggagggatcatgcttgacgggtcgggttgggatcatccgggtatgggtttgggtttgaggagaaccgaaccgggtaataataataataacccatggaccgatctggctatgaacagagcggagaaaaactga

SEQ ID NO: 406 - protein, 204 aa, Arabidopsis thaliana
MQDPAAYYQTMMAKQQQQQQPQFAEQEQLKCPRCDSPNTKFCYYNNYNLSQPRHFCKSCRRYWTKGGALRNVPVGGGSRKNATKRSTSSSSSASSPSNSSQNKKTKNPDPDPDPRNSQKPDLDPTRMLYGFPIGDQDVKGMEIGGSFSSLLANNMQLGLGGGGIMLDGSGWDHPGMGLGLRRTEPGNNNNNPWTDLAMNRAEKN

SEQ ID NO: 407 - DNA, 924 bp, Arabidopsis thaliana
atgcaagatattcatgatttctccatgaacggagttggtggtgggggaggaggaggagggaggtttttcggtggaggaatcggcggcggaggaggtggtgatcgaaggatgagagctcatcagaacaatatacttaaccatcatcaatctctcaagtgtcctcgttgtaattctcttaacacaaagttctgttactacaacaattacaatctttctcagcctcgtcacttttgcaagaactgtcgtcgttactggactaaaggtggtgttctccgtaacgttcccgtcggaggtggttgccggaaagctaaacgttcgaaaacaaaacaggttccgtcgtcgtcatcagccgacaaaccaacgacgacgcaagatgatcatcacgtggaggagaaatcgagtacaggatctcactctagcagcgagagctcttctctcaccgcttctaactctaccaccgtcgccgccgtctccgtcaccgcggcggcggaagttgcttcgtcggttattccaggttttgatatgcctaatatgaaaatttacggtaacgggatcgagtggtcgacgttacttggacaaggctcatcggccggtggtgttttctcggagatcggtggttttccggcggtttcagctattgaaactacaccgtttggattcgggggtaaattcgtaaatcaagatgatcatctgaagttagaaggtgaaactgtacagcagcaacagtttggagatcgaacggctcaggttgagtttcaaggaagatcttcggatccgaatatgggatttgaaccgttggattggggaagtggcggtggagatcaaacactgtttgatttaaccagtaccgttgatcatgcatactggagtcaaagtcaatggacgtcgtctgaccaagatcagagtggtctctaccttccttga

SEQ ID NO: 408 - protein, 307 aa, Arabidopsis thaliana
MQDIHDFSMNGVGGGGGGGGRFFGGGIGGGGGGDRRMRAHQNNILNHHQSLKCPRCNSLNTKFCYYNNYNLSQPRHFCKNCRRYWTKGGVLRNVPVGGGCRKAKRSKTKQVPSSSSADKPTTTQDDHHVEEKSSTGSHSSSESSSLTASNSTTVAAVSVTAAAEVASSVIPGFDMPNMKIYGNGIEWSTLLGQGSSAGGVFSEIGGFPAVSAIETTPFGFGGKFVNQDDHLKLEGETVQQQQFGDRTAQVEFQGRSSDPNMGFEPLDWGSGGGDQTLFDLTSTVDHAYWSQSQWTSSDQDQSGLYLP

SEQ ID NO: 409 - DNA, 795 bp, Arabidopsis thaliana
atggtggaacgtgctcggatcgcaaaagtcccattgcctgaagcagctctaaattgccctagatgtgactcaaccaatactaagttctgttacttcaataactatagccttactcaacctcgccatttctgcaaaacatgtcgtcgctattggacacgtggcggttccttgaggaatgttcctgttggaggaggctttaggaggaacaagagaagcaaatccagatcgaaatctacggtcgtggtctcgactgataatactactagtacttcatcacttacttctcgcccaagttactcaaaccctagcaagtttcatagctacggtcaaatcccggagtttaattccaacttgcccatcttgcctcctctccaaagccttggagattacaattcaagcaacactggattagattttggtggaactcaaataagcaacatgataagtggtatgagttctagtggtgggatcttggatgcatggagaatacctccatcacaacaagctcagcaattccctttcttgatcaacactaccggattggtgcaatcttcaaacgcgttatatccattactagaaggcggggttagcgccacgcaaacaagaaatgtgaaggcggaagagaatgatcaggatcggggtagggatggggatggagtgaataacttatcaagaaactttttgggtaatatcaacataaactcaggcaggaacgaggaatacacatcatggggaggtaacagttcttggaccggtttcacctccaacaactcaacaggccatctctcattctaa

SEQ ID NO: 410 - protein, 264 aa, Arabidopsis thaliana
MVERARIAKVPLPEAALNCPRCDSTNTKFCYFNNYSLTQPRHFCKTCRRYWTRGGSLRNVPVGGGFRRNKRSKSRSKSTVVVSTDNTTSTSSLTSRPSYSNPSKFHSYGQIPEFNSNLPILPPLQSLGDYNSSNTGLDFGGTQISNMISGMSSSGGILDAWRIPPSQQAQQFPFLINTTGLVQSSNALYPLLEGGVSATQTRNVKAEENDQDRGRDGDGVNNLSRNFLGNININSGRNEEYTSWGGNSSWTGFTSNNSTGHLSF

SEQ ID NO: 411 - DNA, 744 bp, Arabidopsis thaliana
atggagagagcagaggccttgacatcatcgtttatatggcggccaaacgcaaacgcaaacgcggagatcacgccgagttgtccaagatgtggatcctctaacacaaagttctgttactacaacaactatagcctcactcagcctcgctacttctgcaaaggctgccgcagatattggaccaaaggtggttccctccgcaatgttcctgtaggcggtggctgtcgaaaatcccgccgccccaaatcatcttctggtaacaatactaaaactagcctaaccgctaattctggcaaccccggtggtggttcaccaagcatcgatcttgctcttgtttacgccaatttcttgaatccaaagcctgacgaatctatactacaagaaaattgcgacttagccactacggattttttggtagataatcctaccggcacttccatggacccttcatggagtatggacatcaatgatggtcatcatgatcattatattaatccggtggaacacattgtggaggaatgtggttataatggcttgcctccatttcctggtgaagagcttctctctttagacactaatggtgtttggtctgatgctttgttgattggtcataaccatgtagacgttggcgtgactccggttcaggctgtacacgaaccggtggttcatttcgctgacgaatccaatgattccaccaatctcttgtttggaagttggagcccttttgatttcactgccgatggatga

SEQ ID NO: 412 - protein, 247 aa, Arabidopsis thaliana
MERAEALTSSFIWRPNANANAEITPSCPRCGSSNTKFCYYNNYSLTQPRYFCKGCRRYWTKGGSLRNVPVGGGCRKSRRPKSSSGNNTKTSLTANSGNPGGGSPSIDLALVYANFLNPKPDESILQENCDLATTDFLVDNPTGTSMDPSWSMDINDGHHDHYINPVEHIVEECGYNGLPPFPGEELLSLDTNGVWSDALLIGHNHVDVGVTPVQAVHEPVVHFADESNDSTNLLFGSWSPFDFTADG

SEQ ID NO: 413 - DNA, 945 bp, Arabidopsis thaliana
atggagagatacaagtgtagattttgcttcaagagcttcatcaatggaagagctttaggtggtcacatgagatctcacatgcttactctttctgcagaacgttgtgtaataactggtgaagcagaagaagaagtagaggaacggccgagtcaactctgtgacgacgacgacgataccgagtccgatgcttcttcttcttctggtgagtttgataatcaaaagatgaatcgtcttgatgatgaattggagtttgatttcgctgaagacgacgacgttgaaagtgaaaccgagtcgtccaggattaacccaactcggcgacgatctaaacgaactcggaaacttggatcgtttgatttcgactttgagaagctaacaacgagccaacccagtgagttagtggccgagccagagcatcacagctcagcttctgatacaacaacggaggaagatctcgccttttgtctcattatgctgtccagagacaaatggaagcaacagaagaagaagaagcaacgtgtagaagaagatgagacagatcatgacagtgaagattacaaatcaagcaagagcagagggagattcaagtgtgagacttgtggtaaagtgtttaaatcgtatcaagcattaggaggacacagagcaagccacaagaagaacaaggcatgcatgacgaaaacagagcaagttgaaacagagtacgttcttggagtaaaggagaagaaagttcatgaatgtccgatctgttttagggtttttacttcagggcaagcacttggaggtcataagagatctcacggaagtaacatcggagcaggaagaggattgtcagtaagtcaaattgtccaaatcgaagaagaagtatcagtgaaacagaggatgattgatcttaatcttcctgcacctaatgaagaagatgaaacttctttggtgtttgatgaatggtga

SEQ ID NO: 414 - protein, 314 aa, Arabidopsis thaliana
MERYKCRFCFKSFINGRALGGHMRSHMLTLSAERCVITGEAEEEVEERPSQLCDDDDDTESDASSSSGEFDNQKMNRLDDELEFDFAEDDDVESETESSRINPTRRRSKRTRKLGSFDFDFEKLTTSQPSELVAEPEHHSSASDTTTEEDLAFCLIMLSRDKWKQQKKKKQRVEEDETDHDSEDYKSSKSRGRFKCETCGKVFKSYQALGGHRASHKKNKACMTKTEQVETEYVLGVKEKKVHECPICFRVFTSGQALGGHKRSHGSNIGAGRGLSVSQIVQIEEEVSVKQRMIDLNLPAPNEEDETSLVFDEW

SEQ ID NO: 415 - DNA, 945 bp, Arabidopsis thaliana
atggaagaaaatcttcctccggggttcagatttcatcctacagacgaggagctcataacgcattatctatgtcggaaagtctccgatataggattcaccggtaaagctgtcgtcgacgttgatctcaacaagtgtgaaccttgggatttgccagccaaggcttcaatgggagagaaagagtggtatttcttcagccaaagggatcggaaatatccaaccggtttaagaacaaaccgggcaacagaagctggttactggaaaaccaccgggaaagataaagaaatataccgaagtggagtgttggttgggatgaagaaaaccctagttttctacaaaggaagagctcccaaaggtgagaaaagcaattgggttatgcatgagtacaggcttgagagcaaacaacctttcaaccccacgaataaggaggaatgggtagtgtgtagggttttcgaaaagagcacggcagcaaagaaagcacaagaacaacaacctcaatcttctcaaccatcttttggatctccatgcgatgcaaactcatcaatggcaaatgagtttgaagatattgatgagcttccgaatctgaattcaaactcatcaaccatcgattacaataatcatatccatcaatattcgcaacgcaatgtttactcagaagacaacacaacaagtacggctggtctcaacatgaacatgaacatggctagtactaatcttcagtcttggacaacaagtctccttggtccgcctttatctccaatcaactctttgttgctcaaggctttccaaatcaggaactcttatagtttcccaaaagagatgatccccagtttcaatcattcttctcttcaacaaggagtctccaatatgatccaaaatgcttcaagttcgtctcaagtgcaaccccaaccgcaagaggaagcgtttaatatggactccatatggtga

SEQ ID NO: 416 - protein, 314 aa, Arabidopsis thaliana
MEENLPPGFRFHPTDEELITHYLCRKVSDIGFTGKAVVDVDLNKCEPWDLPAKASMGEKEWYFFSQRDRKYPTGLRTNRATEAGYWKTTGKDKEIYRSGVLVGMKKTLVFYKGRAPKGEKSNWVMHEYRLESKQPFNPTNKEEWVVCRVFEKSTAAKKAQEQQPQSSQPSFGSPCDANSSMANEFEDIDELPNLNSNSSTIDYNNHIHQYSQRNVYSEDNTTSTAGLNMNMNMASTNLQSWTTSLLGPPLSPINSLLLKAFQIRNSYSFPKEMIPSFNHSSLQQGVSNMIQNASSSSQVQPQPQEEAFNMDSIW

SEQ ID NO: 417 - DNA, 366 bp, Arabidopsis thaliana
atgtgtagaggcttgaataatgaagagagcagaagaagtgacggaggaggttgccggagtctctgcacgagaccgagtgttccggtaaggtgtgagctttgcgacggagacgcctccgtgttctgtgaagcggactcggcgttcctctgtagaaaatgtgaccggtgggttcatggagcgaattttctagcttggagacacgtaaggcgcgtgctatgcacttcttgtcagaaactcacgcgccggtgcctcgtcggagatcatgacttccacgttgttttaccgtcggtgacgacggtcggagaaaccaccgtggagaatagaagtgaacaagataatcatgaggttccgtttgtttttctctga

SEQ ID NO: 418 - protein, 121 aa, Arabidopsis thaliana
MCRGLNNEESRRSDGGGCRSLCTRPSVPVRCELCDGDASVFCEADSAFLCRKCDRWVHGANFLAWRHVRRVLCTSCQKLTRRCLVGDHDFHVVLPSVTTVGETTVENRSEQDNHEVPFVFL

SEQ ID NO: 419 - DNA, 1155 bp, Arabidopsis thaliana
attcacattactaatctctcaagatttcacaattttcttgtgattttctctcagtttcttatttcgtttcataacatggatgccatgagtagcgtagacgagagctctacaactacagattccattccggcgagaaagtcatcgtctccggcgagtttactatatagaatgggaagcggaacaagcgtggtacttgattcagagaacggtgtcgaagtcgaagtcgaagccgaatcaagaaagcttccttcttcaagattcaaaggtgttgttcctcaaccaaatggaagatggggagctcagatttacgagaaacatcaacgcgtgtggcttggtactttcaacgaggaagacgaagcagctcgtgcttacgacgtcgcggctcaccgtttccgtggccgcgatgccgttactaatttcaaagacacgacgttcgaagaagaggttgagttcttaaacgcgcattcgaaatcagagatcgtagatatgttgagaaaacacacttacaaagaagagttagaccaaaggaaacgtaaccgtgacggtaacggaaaagagacgacggcgtttgctttggcttcgatggtggttatgacggggtttaaaacggcggagttactgtttgagaaaacggtaacgccaagtgacgtcgggaaactaaaccgtttagttataccaaaacaccaagcggagaaacattttccgttaccgttaggtaataataacgtctccgttaaaggtatgctgttgaatttcgaagacgttaacgggaaagtgtggaggttccgttactcttattggaatagtagtcaaagttatgtgttgaccaaaggttggagtagattcgttaaagagaagagactttgtgctggtgatttgatcagttttaaaagatccaacgatcaagatcaaaaattctttatcgggtggaaatcgaaatccgggttggatctagagacgggtcgggttatgagattgtttggggttgatatttctttaaacgccgtcgttgtagtgaaggaaacaacggaggtgttaatgtcgtcgttaaggtgtaagaagcaacgagttttgtaataacaatttaacaacttgggaaagaaaaaaaagctttttgattttaatttctcttcaacgttaatcttgctgagatta

SEQ ID NO: 420 - protein, 333 aa, Arabidopsis thaliana
MDAMSSVDESSTTTDSIPARKSSSPASLLYRMGSGTSVVLDSENGVEVEVEAESRKLPSSRFKGVVPQPNGRWGAQIYEKHQRVWLGTFNEEDEAARAYDVAAHRFRGRDAVTNFKDTTFEEEVEFLNAHSKSEIVDMLRKHTYKEELDQRKRNRDGNGKETTAFALASMVVMTGFKTAELLFEKTVTPSDVGKLNRLVIPKHQAEKHFPLPLGNNNVSVKGMLLNFEDVNGKVWRFRYSYWNSSQSYVLTKGWSRFVKEKRLCAGDLISFKRSNDQDQKFFIGWKSKSGLDLETGRVMRLFGVDISLNAVVVVKETTEVLMSSLRCKKQRVL

SEQ ID NO: 421 - DNA, 1269 bp, Arabidopsis thaliana
  misc_feature (1239)..(1267): n=a,t,c or g
ttttctttttctttctttttggtttaagttttttctctttgttcttcgtcatgtctcatgaaatcaaagatcttaacaactatcactacacttcatcgtataatcattacaatatcaacaaccaaaatatgattaatctcccttacgtttctggtccatctgcttataatgcaaacatgatctcatcatcacaagtaggttttgatctaccctcgaagaacttgagtcctcaaggagccttcgagttgggtttcgagctttctccatcttcttctgacttttttaatccttccctcgatcaagagaacggtttgtataatgcttataattataatagtagtcaaaagagtcatgaagttgtcggtgatggttgtgcaaccattaagagtgaagttagggtttcagcatctccttcttcaagtgaggccgatcatcatccaggagaagattccggcaagatccggaagaaaagagaagttcgcgatggaggagaagatgatcaacgctctcagaaagtagttaaaacaaagaagaaagaggagaagaaaaaagagccacgagtctcgttcatgactaagaccgaagttgatcatctcgaagacggctatcgttggagaaagtatggccaaaaagcagtcaaaaacagtccttatccgaggagttactatagatgcacgactcagaagtgcaacgtgaagaagagagtggagagatcttaccaagacccaacggtcgtcatcacaacctacgagagtcaacacaaccatccgatcccgaccaatcgtcggacagcaatgttctctggaaccaccgcatctgattataacccatcatcgtctccaatattctccgatctcatcatcaatactccaagaagcttctcaaatgatgatctcttccgtgtgccatacgctagtgtgaacgtgaaccctagttatcatcaacagcaacatggatttcatcaacaggagagtgagttcgagctcttgaaggagatgtttccttcggttttcttcaaacaagagccttgatgatataatataatatagaaacaattttttttctgctaagaaatatagaacaaaacttggatgcataataagtgatgatagtgttatttattttttgcatgtatatattatacatgttttgttaactagctataggatatactggtagtaattaagcataaatatggagcccttcgacttattacaataatttttggtatggaaaaanttngntacatgcctgccttttnnnttnngg

SEQ ID NO: 422 - protein, 326 aa, Arabidopsis thaliana
MSHEIKDLNNYHYTSSYNHYNINNQNMINLPYVSGPSAYNANMISSSQVGFDLPSKNLSPQGAFELGFELSPSSSDFFNPSLDQENGLYNAYNYNSSQKSHEVVGDGCATIKSEVRVSASPSSSEADHHPGEDSGKIRKKREVRDGGEDDQRSQKVVKTKKKEEKKKEPRVSFMTKTEVDHLEDGYRWRKYGQKAVKNSPYPRSYYRCTTQKCNVKKRVERSYQDPTVVITTYESQHNHPIPTNRRTAMFSGTTASDYNPSSSPIFSDLIINTPRSFSNDDLFRVPYASVNVNPSYHQQQHGFHQQESEFELLKEMFPSVFFKQEP

SEQ ID NO: 423 - DNA, 1750 bp, Arabidopsis thaliana
atttatgacttctcaatacaaaaagctcccctcacttttttaagttttgtcttctctaatccgtcttcttctactatcttgcatgtcttgcgtcttttatatacatctctcgtaaaccctagcaaatcatacaaggtcaagaagcttgaccttcattagacttaagcagtttataatcaactaccacgaatagcaatggataaagattactcggcaccaaacttcttaggtgaatcctcaggcggtaacgatgataacagctctggtatgatagactatatgttcaatagaaaccttcaacaacaacaaaagcaatcgatgccacaacagcagcaacatcaactctctccttccggatttggagcaacaccctttgataaaatgaacttctctgatgtgatgcagtttgcggacttcggttcgaaacttgcgttgaaccagaccagaaaccaagacgatcaagaaaccgggattgaccccgtttatttcttgaagttccctgtcttgaacgacaaaatagaggaccataaccaaacccaacatctcatgccttctcatcagacgtctcaagaaggaggtgagtgtggaggaaacataggcaatgtgtttcttgaagaaaaagaagatcaagacgatgacaacgacaacaactccgtgcaactacgttttattggaggagaagaagaagatagggagaacaagaatgttacgaaaaaggaggtgaagagcaagaggaagagagctagaacgagcaagaccagcgaagaagtggaaagccaacggatgactcatatcgcggtcgaaagaaaccgtaggaagcaaatgaatgagcatcttcgtgtccttagatctctcatgcctggctcctacgttcaaaggggagaccaagcgtcaatcataggaggagcaatagagtttgtgagagagctcgagcaactcctacaatgtcttgaatcacagaagcgtcgaagaatcttaggagaaaccggtagggacatgacaacgacaacgacttcttcttcttctcccataactacggtagcgaaccaagcacaaccgctcattattacgggaaatgtaaccgagctagagggcggaggagggcttcgggaggagactgcggagaacaagtcgtgcttggctgacgtggaggtgaagctgctagggtttgacgccatgatcaagatactttcaagaagaaggccgggacagctgattaagactatagctgctttggaggatcttcatctctctattcttcacactaacatcactaccatggaacaaaccgtcctctactcctttaatgtcaagataacaagtgaaacgaggtttacggcagaagacatagcaagttccatccaacagatatttagtttcattcatgcaaataccaacatatctggaagctctaacctgggaaatattgtgtttacttgaaaatcatcacacggcgacaactttgtacactggtgaagattacagtacgtaataatctctacatattgggttttattctccaagcatttggaagagtgtttaagttaaagggagtgcttactttatttttttggggcttttttcatgcaatttaaattttagtgatgattgtgtcgcttgtaatgttagaactcgttgttgtgatttctgctgctttgatttgtaggttttgaacaagcggtttagaatgctaaaccacttatttacttgaaataacttttttcacaaaaaaaaaaaaaaaagaaaaaaa

SEQ ID NO: 424 - protein, 414 aa, Arabidopsis thaliana
MDKDYSAPNFLGESSGGNDDNSSGMIDYMFNRNLQQQQKQSMPQQQQHQLSPSGFGATPFDKMNFSDVMQFADFGSKLALNQTRNQDDQETGIDPVYFLKFPVLNDKIEDHNQTQHLMPSHQTSQEGGECGGNIGNVFLEEKEDQDDDNDNNSVQLRFIGGEEEDRENKNVTKKEVKSKRKRARTSKTSEEVESQRMTHIAVERNRRKQMNEHLRVLRSLMPGSYVQRGDQASIIGGAIEFVRELEQLLQCLESQKRRRILGETGRDMTTTTTSSSSPITTVANQAQPLIITGNVTELEGGGGLREETAENKSCLADVEVKLLGFDAMIKILSRRRPGQLIKTIAALEDLHLSILHTNITTMEQTVLYSFNVKITSETRFTAEDIASSIQQIFSFIHANTNISGSSNLGNIVFT

SEQ ID NO: 425 - DNA, 1444 bp, Arabidopsis thaliana
gtaccgtcgaccgattatccccaagaggagaatcctcataatcattttctccgattcgattcgtcttccttggtcctggattgcttcatgaatttctaggacaacaatggaggctcgtccagttcatagatcaggttcgagagacctcacacgcacttcttcaatcccatctacacaaaaaccttcaccagtagaagatagtttcatgagatcagataacaacagtcagttaatgtctagaccattaggacaaacctaccatttactttcatctagtaacggtggagctgttggacatatatgttcttcttcatcatctggttttgcaaccaatctccattactcaactatggtatctcatgagaaacaacaacactacacaggaagcagcagtaataatgctgtgcagacaccaagcaacaacgatagtgcttggtgtcatgattcattgccaggagggtttcttgacttccatgaaaccaacccggcgattcaaaacaactgtcagattgaggatggtggcattgcggctgcttttgatgacattcaaaaacgaagtgattggcatgaatgggctgaccatttgatcactgatgatgatcctttgatgtctactaactggaatgatctcttgcttgaaacaaattccaattcagattcaaaggaccagaagacactgcaaattccgcaacctcagattgttcagcagcaaccttctccgtctgtggaattgcgacctgttagcacaacatcttcaaacagcaataacggaacgggcaaggcacgaatgcgttggacgccagagcttcacgaggcttttgttgaggctgtcaacagtcttggcggtagtgaaagagctactcctaaaggggtactgaagattatgaaagttgaaggcttgactatatatcatgttaaaagccatttacagaaatataggacagctagatatcggccagaaccatcagaaactggttcgccagaaaggaagttgacaccgcttgaacatataacatctcttgatttgaaaggtgggataggtattacagaggctctacgacttcagatggaagtacagaagcaactccatgagcagctcgagattcaaagaaacctgcaactccgaatagaagaacaaggcaagtacctgcaaatgatgttcgagaagcaaaactctggtcttaccaaagggacagcctcaacatcagattccgcagccaaatctgaacaagaagacaagaagactgctgattcgaaggaggttccagaagaagaaaccaggaaatgtgaggaactagaatctccacagccaaagcgtcccaaaatcgataattgaaagtattggtcttttgctggataatctcggagtttcagagttaacagtgatagagagaacgagctcttatcttgaggttcttcaggacttctctcgcggccgctctag

SEQ ID NO: 426 - protein, 409 aa, Arabidopsis thaliana
MEARPVHRSGSRDLTRTSSIPSTQKPSPVEDSFMRSDNNSQLMSRPLGQTYHLLSSSNGGAVGHICSSSSSGFATNLHYSTMVSHEKQQHYTGSSSNNAVQTPSNNDSAWCHDSLPGGFLDFHETNPAIQNNCQIEDGGIAAAFDDIQKRSDWHEWADHLITDDDPLMSTNWNDLLLETNSNSDSKDQKTLQIPQPQIVQQQPSPSVELRPVSTTSSNSNNGTGKARMRWTPELHEAFVEAVNSLGGSERATPKGVLKIMKVEGLTIYHVKSHLQKYRTARYRPEPSETGSPERKLTPLEHITSLDLKGGIGITEALRLQMEVQKQLHEQLEIQRNLQLRIEEQGKYLQMMFEKQNSGLTKGTASTSDSAAKSEQEDKKTADSKEVPEEETRKCEELESPQPKRPKIDN

SEQ ID NO: 427 - DNA, 1501 bp, Arabidopsis thaliana
tcgacatcagatttctctcacggattcctaatcatttttattatatttggatatttgctaattcttcccgtgtataaatctcatataaacacgcatcatacatatatattatgtgcagcgtctttgagtttcaagacatggacaacttccaaggagatctaacagacgtcgtacgaggaataggatcaggccacgtgtcaccatctcctggaccaccggaaggtccatctccgagcagcatgtctccgccgccaacatcagatctccacgtggaattcccctccgccgctacttctgccagctgtctcgcaaatcccttcggagacccgttcgtaagcatgaaggatcctctcatccacctcccggccagctacatctccggcgccggtgataataaaagcaacaaaagttttgcaatctttccaaagatttttgaggatgatcatattaagagtcaatgcagtgtcttcccaagaattaagatctcgcaaagtaacaatatccacgatgcctccacgtgtaattctccggccataaccgtctcctctgccgccgtagcagcttcgccgtggggcatgatcaacgttaataccactaacagtccaagaaactgtttacttgtcgataataataacaacacgtcatcatgctcacaggttcagatctcttcttcccctcggaatctcggaattaagagaaggaagagccaggcaaagaaagtggtgtgcataccggctccagccgctatgaacagccggtccagtggagaagttgttccgtctgatctatgggcttggcgaaagtacggtcaaaaacctatcaaaggttctccttatccaaggggttactacagatgtagcagctcaaaaggttgttcagctaggaaacaagtcgaacgtagccgcactgatccaaacatgttagtcattacttacacctctgagcataaccacccatggcctactcaacgcaacgctctcgcaggttccactcgttcctcttcctcctcctctttaaacccttcttccaaatcctcaaccgcagccgccactacttctccctcatccagagttttccaaaacaacagcagcaaagacgaacccaataactccaacttgccttcctcttccactcatcctccttttgacgccgccgcaattaaggaggagaacgtggaagagcgtcaggaaaagatggagttcgattataatgacgttgaaaatacctatagaccggagttgttgcaagagtttcaacatcagccggaggatttctttgccgatctcgacgagcttgagggagattctttgactatgttgctctctcacagtagcggcggaggcaacatggaaaacaaaacgacgattccagacgtttttagtgatttctttgacgacgacgagtcctcaaggtcgttataaatattgttgttaatgtatacatagaaatgaaattattcatgtaattcgttttgtgttaaatgacggtatttgcctttgca

SEQ ID NO: 428 - protein, 436 aa, Arabidopsis thaliana
MCSVFEFQDMDNFQGDLTDVVRGIGSGHVSPSPGPPEGPSPSSMSPPPTSDLHVEFPSAATSASCLANPFGDPFVSMKDPLIHLPASYISGAGDNKSNKSFAIFPKIFEDDHIKSQCSVFPRIKISQSNNIHDASTCNSPAITVSSAAVAASPWGMINVNTTNSPRNCLLVDNNNNTSSCSQVQISSSPRNLGIKRRKSQAKKVVCIPAPAAMNSRSSGEVVPSDLWAWRKYGQKPIKGSPYPRGYYRCSSSKGCSARKQVERSRTDPNMLVITYTSEHNHPWPTQRNALAGSTRSSSSSSLNPSSKSSTAAATTSPSSRVFQNNSSKDEPNNSNLPSSSTHPPFDAAAIKEENVEERQEKMEFDYNDVENTYRPELLQEFQHQPEDFFADLDELEGDSLTMLLSHSSGGGNMENKTTIPDVFSDFFDDDESSRSL

SEQ ID NO: 429 - DNA, 609 bp, Arabidopsis thaliana
atggataacttcaatgttgttgccaatgaagacaatcaagtgaatgatgtgaagcctccaccacccccaccgcgagtgtgtgcaagatgtgattctgataacacaaaattttgttactacaacaattatagtgagtttcaaccgcgctacttctgcaagaactgtcgaagatactggactcatggtggggctttaagaaacgtaccaattggtgggagtagtcgtgccaagcggacaaggataaatcaaccttcagttgctcagatggtttctgttggaatccaaccagggaaccgttttagttctttgtctcatattcatggtggtatggtaacaaatgtgcatccaactcaaacttttcgaccaaatcatcgcctagctttccataatggatcatttgagcaagattattatgatgttgggtctgataatcttttggtaaaccaacaagttggtggatatgttgataatcacaacggttatcacatgaatcaagtggatcaatacaactggaaccagagcttcaataacgctatgaacatgaattataataacgctagcactagcggaaggatgcatcctagtcatttagagaagggtggtccttga

SEQ ID NO: 430 - protein, 202 aa, Arabidopsis thaliana
MDNFNVVANEDNQVNDVKPPPPPPRVCARCDSDNTKFCYYNNYSEFQPRYFCKNCRRYWTHGGALRNVPIGGSSRAKRTRINQPSVAQMVSVGIQPGNRFSSLSHIHGGMVTNVHPTQTFRPNHRLAFHNGSFEQDYYDVGSDNLLVNQQVGGYVDNHNGYHMNQVDQYNWNQSFNNAMNMNYNNASTSGRMHPSHLEKGGP

SEQ ID NO: 431 - DNA, 1152 bp, Arabidopsis thaliana
atgactgatccttattccaatttcttcacagactggttcaagtctaatccttttcaccattaccctaattcctccactaacccctctcctcatcctcttcctcctgttactcctccctcttccttcttcttcttccctcaatccggagacctccgccgtccaccgccgccaccaactcctcctccttctcctcctctccgagaagccctccctctcctcagcctcagccccgccaacaaacaacaagaccaccatcacaaccatgaccaccttattcaagaaccaccttcaacctccatggatgtcgactacgatcatcaccatcaagatgatcatcataacctcgatgacgatgaccatgacgtcaccgttgctcttcacataggccttccaagccctagtgctcaagagatggcctctttgctcatgatgtcttcttcttcctcttcctcgaggaccactcatcatcacgaggacatgaatcacaagaaagacctcgaccatgagtacagccacggagctgtcggaggaggagaagatgacgatgaagattcagtcggcggagacggcggctgtagaatcagcagactcaacaagggtcaatattggatccctacaccttctcagattctcattggccctactcagttctcatgtcctgtttgcttcaaaaccttcaacagatacaataacatgcagatgcatatgtggggacatggatcacaatacagaaaaggacctgaatctctaaggggaacacaaccaacaggaatgctaaggcttccgtgctattgctgcgccccaggctgtcgcaacaacattgaccatccaagggcaaagcctctcaaagacttcagaacccttcaaacacattacaagagaaaacatgggatcaaacctttcatgtgtaggaaatgtggaaaggctttcgcagtccgaggggactggagaacacatgagaagaattgtggcaaactttggtattgcatatgtggatctgatttcaagcacaagagatctctcaaagatcacatcaaggcttttgggaatggtcatggagcctacggaattgatgggtttgatgaagaagatgagcctgcctctgaggtagaacaattagacaatgatcatgagtcaatgcagtctaaatag

SEQ ID NO: 432 - protein, 383 aa, Arabidopsis thaliana
MTDPYSNFFTDWFKSNPFHHYPNSSTNPSPHPLPPVTPPSSFFFFPQSGDLRRPPPPPTPPPSPPLREALPLLSLSPANKQQDHHHNHDHLIQEPPSTSMDVDYDHHHQDDHHNLDDDDHDVTVALHIGLPSPSAQEMASLLMMSSSSSSSRTTHHHEDMNHKKDLDHEYSHGAVGGGEDDDEDSVGGDGGCRISRLNKGQYWIPTPSQILIGPTQFSCPVCFKTFNRYNNMQMHMWGHGSQYRKGPESLRGTQPTGMLRLPCYCCAPGCRNNIDHPRAKPLKDFRTLQTHYKRKHGIKPFMCRKCGKAFAVRGDWRTHEKNCGKLWYCICGSDFKHKRSLKDHIKAFGNGHGAYGIDGFDEEDEPASEVEQLDNDHESMQSK

SEQ ID NO: 433 - DNA, 1307 bp, Arabidopsis thaliana
gccgtctcgacgaatatgctctaccaatgtctgacgaccaattccatcacccgccgcctccttcttcaatgaggcaccgttctacgtcggatgcggcggacggcggctgcggcgagattgttgaggtgcaaggtggtcacattgttcggtctaccggaagaaaagaccgccacagcaaagtctgcacggctaaagggccacgtgaccggcgcgtgagactctctgctcacacggcgattcagttttacgatgttcaagacaggcttggtttcgaccgacctagcaaagccgttgattggcttatcaaaaaggctaagacttccattgacgagctcgctgagcttcctccctggaatcccgccgatgcaattcgcctagccgctgctaacgctaaacccagaagaaccaccgccaaaacccaaatctctccgtctccgccaccgccgcaacagcaacaacaacaacaacagcttcagttcggtgttggcttcaacggaggaggagcagagcatccgagtaacaacgagtcgagttttctcccgccgtcaatggattcagattcgatagctgacactataaagtcgttttttccggtgattggctcttcaacggaggctccttcgaatcataaccttatgcacaactatcatcatcagcatccgccggatttgctttctcgaactaatagccaaaaccaagatctccgtctctcgctgcaatcgttcccggatggtccaccgtcgcttctgcaccaccaacatcaccaccacacctctgcttccgcctccgagcctactctgttctacggacagagcaatccgttagggtttgacacatcgagttgggagcagcagtcgtcggaattcggaaggattcagagactagtggcttggaacagcggcggtggcggcggagcaaccgatacaggaaacggaggagggtttctgttcgctcctcctactccttcaacgacgtcgtttcagccagttcttggccaaagccaacagctttattctcagaggggtccccttcagtccagttacagtcccatgatccgtgcttggtttgatcctcaccatcatcaccaatccatctccaccgacgatctcaaccaccaccatcaccttcctccaccggttcaccaatcagcaatccccggaatcggattcgcctcaggtgaattctcttcgggttttcgcataccagcacggtttcagggccaagaagaggagcagcacgacggtctcactcacaagccgtcctctgcttcctctatttctcgccattgacaatcgaaactaatcctc

SEQ ID NO: 434 - protein, 420 aa, Arabidopsis thaliana
MSDDQFHHPPPPSSMRHRSTSDAADGGCGEIVEVQGGHIVRSTGRKDRHSKVCTAKGPRDRRVRLSAHTAIQFYDVQDRLGFDRPSKAVDWLIKKAKTSIDELAELPPWNPADAIRLAAANAKPRRTTAKTQISPSPPPPQQQQQQQQLQFGVGFNGGGAEHPSNNESSFLPPSMDSDSIADTIKSFFPVIGSSTEAPSNHNLMHNYHHQHPPDLLSRTNSQNQDLRLSLQSFPDGPPSLLHHQHHHHTSASASEPTLFYGQSNPLGFDTSSWEQQSSEFGRIQRLVAWNSGGGGGATDTGNGGGFLFAPPTPSTTSFQPVLGQSQQLYSQRGPLQSSYSPMIRAWFDPHHHHQSISTDDLNHHHHLPPPVHQSAIPGIGFASGEFSSGFRIPARFQGQEEEQHDGLTHKPSSASSISRH

SEQ ID NO: 435 - DNA, 845 bp, Arabidopsis thaliana
accacaaaacagagcaacacacaacacaaagcttcatttcaattctgtttcgagaaccctttgagaaccagatcggagatggaaaacgacgatatcaccgtggcggagatgaagccaaagaagcgtgctggacggaggattttcaaggagacacgtcacccaatctacagaggcgtgcggcgtagggacggcgacaaatgggtatgcgaagtccgtgaaccgattcatcagcgtcgagtctggctcggaacttatccgacggcagatatggccgcacgtgctcacgacgtggcggttcttgctctgcgcgggagatccgcgtgtttgaatttctccgattctgcttggaggttgccggtgccggcatccactgatccggacacgatcaggcgcacggcggccgaagcagcggagatgttcaggccgccggagtttagtacaggaattacggttttaccctcagccagtgagtttgacacgtcggatgaaggagtcgctggaatgatgatgaggctcgcggaggagccgttgatgtcgccgccaagatcgtacattgatatgaatacgagtgtgtacgtggacgaagaaatgtgttacgaagatttgtcactttggagttactaaaatacgtatgtgttaaaaaaccaaagatcgtatgtgtatgtatgcataataaatgggcttaatgatgggcatagatatgataggtccagcctatatgttaaatgtgttttattttttggtttatctagtttcctaggtatttaccaaattgtattagtataagttttattaagaaataatcaaaaatgttgttgccaaaaaaaaaaaaaaaaaaaaaaaaa

SEQ ID NO: 436 - protein, 181 aa, Arabidopsis thaliana
MENDDITVAEMKPKKRAGRRIFKETRHPIYRGVRRRDGDKWVCEVREPIHQRRVWLGTYPTADMAARAHDVAVLALRGRSACLNFSDSAWRLPVPASTDPDTIRRTAAEAAEMFRPPEFSTGITVLPSASEFDTSDEGVAGMMMRLAEEPLMSPPRSYIDMNTSVYVDEEMCYEDLSLWSY

SEQ ID NO: 437 - DNA, 750 bp, Arabidopsis thaliana
atgatgtcatgtggtgggaagaagccagtgtctaagaaaacaacgccgtgttgcacgaagatggggatgaagagaggaccatggacggtggaggaagacgagattcttgtgagcttcattaagaaagaaggtgaaggacggtggcgatcgcttcctaagagagctggtttactcagatgtggaaagagctgtcgtctacggtggatgaactatctccgaccctcggttaaacgtggaggaattacgtcggacgaggaagatctcatcctccgtcttcaccgcctcctcggcaacaggtggtcattgatcgcgggaaggataccgggaaggactgataatgaaattaagaactattggaacactcatcttcgtaagaaacttttaaggcaaggaattgatcctcaaacccacaagcctcttgatgcaaacaacatccataaaccagaagaagaagtttccggtggacaaaagtaccctctagagcctatttctagttctcatactgatgataccactgttaatggcggggatggagatagcaagaacagtatcaatgtctttggtggtgaacacggctacgaagactttggtttctgctacgacgacaagttctcatcgtttcttaattcgctcatcaacgatgttggtgatccttttggtaatattatcccaatatctcaacctttgcagatggatgattgtaaggatgggattgttggagcgtcgtcttctagcttaggacatgactag

SEQ ID NO: 438 - protein, 249 aa, Arabidopsis thaliana
MMSCGGKKPVSKKTTPCCTKMGMKRGPWTVEEDEILVSFIKKEGEGRWRSLPKRAGLLRCGKSCRLRWMNYLRPSVKRGGITSDEEDLILRLHRLLGNRWSLIAGRIPGRTDNEIKNYWNTHLRKKLLRQGIDPQTHKPLDANNIHKPEEEVSGGQKYPLEPISSSHTDDTTVNGGDGDSKNSINVFGGEHGYEDFGFCYDDKFSSFLNSLINDVGDPFGNIIPISQPLQMDDCKDGIVGASSSSLGHD

SEQ ID NO: 439 - DNA, 485 bp, Arabidopsis thaliana
atctcatcttcatccacccaaaaacatggattcaagagacaccggagaaactgaccagagcaagtacaaaggtatccgtcgtcggaaatggggaaaatgggtatcagagattcgtgtcccgggaactcgtcaacgtctctggttaggctctttctccaccgcagaaggcgctgccgtagcccacgacgtcgctttttactgcttgcaccgaccatcttccctcgacgacgaatcttttaacttccctcacttacttacaacctccctcgcctccaatatatctcctaagtccatccaaaaagctgcttccgacgccggcatggccgtggacgccggattccatggtgctgtgtctgggagtggtggttgtgaagagagatcttccatggcgaatatggaggaggaggacaaacttagtatctccgtgtatgattatcttgaagacgatctcgtttgatctatacgagtacgtttttagcagttaa

SEQ ID NO: 440 - protein, 143 aa, Arabidopsis thaliana
MDSRDTGETDQSKYKGIRRRKWGKWVSEIRVPGTRQRLWLGSFSTAEGAAVAHDVAFYCLHRPSSLDDESFNFPHLLTTSLASNISPKSIQKAASDAGMAVDAGFHGAVSGSGGCEERSSMANMEEEDKLSISVYDYLEDDLV

SEQ ID NO: 441 - DNA, 904 bp, Arabidopsis thaliana
gagcaaaaactttgtgtgcgtgtgtgtgtgtgttcatggctggtcttaggaattccggtaacagcgacaaagcgcaaaacgatggcaaaggtgtaccatctgcctacagaggagtccggaagagaaaatgggggaaatgggtgtctgaaatccgtgaaccggggaccaagaaccgtatctggctaggcagtttcgagactcctgaaatggctgcaaccgcatacgacgtggcagcatttcatttcagagggagagaagctcgtctcaacttccctgagctcgccagcagccttccacgtcctgcagactctagctcagacagcattcgcatggcagttcatgaggcaacactctgccgcaccaccgaaggaacagagtcagccatgcaagtggacagctcaagctcctccaatgtagctccaacaatggtcagactctcgcccagggaaattcaagcgatcaacgagtcaactttgggatctcctactacaatgatgcattcaacatacgaccctatggagtttgctaatgatgtggagatgaatgcttgggaaacataccagagtgactttctttgggacccttaaccccaaaacctaactcatggagagcttctacagctcaatcttacaataccagcataagttactggcttagaatacttaaatttattgaagtttagttttcagagtctaccacaagggttgttgattctgacgttatagcaaagaataaagctcatcagattttggagggaaagactctatgagcttgatgggtccctgaaaggacctcttcacaaatatttttaaatttttttgttactagtagaaacatagattatgaggtgtgacttattattattttttacaattgtttgttacctcattgatgtatttgattt

SEQ ID NO: 442 - protein, 183 aa, Arabidopsis thaliana
MAGLRNSGNSDKAQNDGKGVPSAYRGVRKRKWGKWVSEIREPGTKNRIWLGSFETPEMAATAYDVAAFHFRGREARLNFPELASSLPRPADSSSDSIRMAVHEATLCRTTEGTESAMQVDSSSSSNVAPTMVRLSPREIQAINESTLGSPTTMMHSTYDPMEFANDVEMNAWETYQSDFLWDP

SEQ ID NO: 443 - DNA, 1496 bp, Arabidopsis thaliana
ttttttttttagggttcataagaacaaattggattttgagctcacagtataaataacccgactttgattactgggtaattttaaaaccgccattgttgttctctttactacttttgggaattagggtttatgatttctgggtattagattagataaatttgtttcctttttttgttaatcaatttaaaaatctcttatttctgttaaagacttgtaattttggagtttttaatgcatggacggaagagaagcaatggcatttccaggctcgcattctcagtactatcttcaaagaggagcctttactaatctcgcaccttcccaagtcgcgagtgggcttcacgcgccgccgccacatacgggattgaggccaatgtctaaccctaacattcatcaccctcaggctaacaatccaggacctcctttctcggattttggacacaccattcacatgggagtggtctcctctgcttctgatgctgatgtgcaaccgccaccgccaccgccaccaccagaggaaccgatggttaagaggaaacgtggacggccaagaaagtatggagaaccgatggttagtaataagtctagggactcttctccaatgtctgatcctaatgaacctaaacgggccagaggtcgacctcctggaactggaaggaagcaacgcttggctaatcttggtgagtggatgaatacttcagctggacttgcttttgcacctcatgtgatcagcattggagcaggagaagacattgctgcgaaagttttgtcattttcacaacaaagacctcgggctctttgtataatgtcaggcactggaaccatttcttcagtcactctgtgcaaacccggttcaaccgatcgtcacttaacatacgagggaccttttgagattataagttttggtggatcttatttggtgaatgaagaaggtggatccagaagtcgaacaggcggattgagtgtctctctttctcgtcccgatggtagtattattgccggtggagttgacatgcttatcgcagccaaccttgttcaggtggtggcatgtagttttgtatacggagcaagggcaaagactcataataacaataacaagaccatcagacaagaaaaggaaccaaatgaagaggacaacaatagtgaaatggagaccacaccgggtagtgcagctgaaccagcagcatctgcgggtcagcagacgccacagaacttctcttctcagggaataagggggtggcccggttcaggctcaggctctggcagatcacttgacatttgcagaaacccactcactgattttgatttgactcgtggatgatatacactattagtctttgaagcagcagcatacaaaatgtgattgctgtacatatgttattgtagatttctctctgggaatgttgaaatcagacatttaaggattgatactagatctctcagctccttctaacattgttaatgtaacagaaccctcccactttcatgctatttgc

SEQ ID NO: 444 - protein, 361 aa, Arabidopsis thaliana
MDGREAMAFPGSHSQYYLQRGAFTNLAPSQVASGLHAPPPHTGLRPMSNPNIHHPQANNPGPPFSDFGHTIHMGVVSSASDADVQPPPPPPPPEEPMVKRKRGRPRKYGEPMVSNKSRDSSPMSDPNEPKRARGRPPGTGRKQRLANLGEWMNTSAGLAFAPHVISIGAGEDIAAKVLSFSQQRPRALCIMSGTGTISSVTLCKPGSTDRHLTYEGPFEIISFGGSYLVNEEGGSRSRTGGLSVSLSRPDGSIIAGGVDMLIAANLVQVVACSFVYGARAKTHNNNNKTIRQEKEPNEEDNNSEMETTPGSAAEPAASAGQQTPQNFSSQGIRGWPGSGSGSGRSLDICRNPLTDFDLTRG

SEQ ID NO: 445 - DNA, 1666 bp, Arabidopsis thaliana
gcaaaaagaaaaaatgaaaaaaaatccctaactctctctctctagaaattcttatttttgtgcgtatctctctaaaaaggaatggatcctaacgaaagccaccatcaccaccaacaacaacagctccatcacctccaccaacagcaacagcaacagcagcagcagcaacgactcacttctccttacttccaccaccaactacagcaccatcaccaccttccaaccaccgtagcaaccaccgcttctaccggaaacgccgttccatcttccaacaatgggcttttccctccgcagcctcagccacagcaccagcctaatgatgggtcatcttctctcgcggtgtaccctcattcagttccgtcctcggctgtgacggcgccgatggagccggtaaagaggaagaggggtcgaccaagaaagtatgtgacgccggaacaagccctagcggctaagaaattggcgtcttctgcgagtagttcgtctgctaaacagaggcgagagcttgctgctgttaccggtggtacggtatcgactaattccgggtcatccaagaaatctcagcttggttctgtcgggaaaactggacaatgttttactccgcatattgttaatatagctcctggcgaggatgtggtccagaaaattatgatgttcgcaaaccaaagcaagcatgaactatgcgttctttctgcatcaggcactatctctaatgcatccttgcgccaaccggctccatcaggaggcaacttaccatatgagggtcaatacgagattctctcactatctggatcctatatccgaactgaacaaggtggtaaatccggcggccttagcgtttctttatctgcttcagatggtcagatcatcggtggagcgattggtagccatctcacagctgctggcccggttcaggtgattcttggtacgtttcagcttgatagaaagaaggatgccgccgggagtggtgggaaaggggatgcttcaaacagtggaagtcggttaacttctcctgtaagctctggacagttgcttggcatgggtttccctcctggtatggaatctacgggaagaaatccaatgaggggaaacgacgagcaacatgatcatcatcatcatcaagccggtttgggtggacctcatcatttcatgatgcaagcgccgcaggggatacacatgacacattccaggccatctgaatggcgcggaggaggcaacagcggtcatgatggcagaggcggtggcgggtatgatttgtcaggaaggataggacatgagtcgtcggagaatggagattacgagcagcaaataccggattagcagagcttccaggagaagtgtgtagagtttagatcccaagtagagaaacagaaggcgagcaaagaatctgaactgagagaggacttattagacagagactcgtctgaagggtctttaatcatagaaagaagttgctgagtgattgcttttgttcttcttcttggtacggtgtattatattaactccacaaccttttttttatactttcagtaacgattctccttcactttcaatttcattccttttttttatactctttttcttttcttataatattttttttggtttttctttcgtttgttactaaaaaaggaaatgctctttttgtgaaatatatacacttcgtttg

SEQ ID NO: 446 - protein, 411 aa, Arabidopsis thaliana
MDPNESHHHHQQQQLHHLHQQQQQQQQQQRLTSPYFHHQLQHHHHLPTTVATTASTGNAVPSSNNGLFPPQPQPQHQPNDGSSSLAVYPHSVPSSAVTAPMEPVKRKRGRPRKYVTPEQALAAKKLASSASSSSAKQRRELAAVTGGTVSTNSGSSKKSQLGSVGKTGQCFTPHIVNIAPGEDVVQKIMMFANQSKHELCVLSASGTISNASLRQPAPSGGNLPYEGQYEILSLSGSYIRTEQGGKSGGLSVSLSASDGQIIGGAIGSHLTAAGPVQVILGTFQLDRKKDAAGSGGKGDASNSGSRLTSPVSSGQLLGMGFPPGMESTGRNPMRGNDEQHDHHHHQAGLGGPHHFMMQAPQGIHMTHSRPSEWRGGGNSGHDGRGGGGYDLSGRIGHESSENGDYEQQIPD

SEQ ID NO: 447 - DNA, 1496 bp, Arabidopsis thaliana
tcttttgattttaaccttttttcagtagcaagccaaaaaaaaaaaacagacaaagaagttccttttatgataaaggtatgatgatagcaaacaaatgatacccccatgtcttgtgtgtctgcttcatgcaacatgttggtttggatttggttaatctaaaagtttaagataaggttttcggattctcttcctgtcttgtaatagtttcttgtcggagagccatcaacaccaacttcaacaaaaaaaacaagaaaaagaaaaagattctctttctcgttttatttccattagagaagaaaaaaagaatggcgaatccttggtgggtagggaatgttgcgatcggtggagttgagagtccagtgacgtcatcagctccttctttgcaccacagaaacagtaacaacaacaacccaccgactatgactcgttcggatccaagattggaccatgacttcaccaccaacaacagtggaagccctaatacccagactcagagccaagaagaacagaacagcagagacgagcaaccagctgttgaacccggatccggatccgggtctacgggtcgtcgtcctagaggtagacctcctggttccaagaacaaaccaaagagtccagttgttgttaccaaagaaagccctaactctctccagagccatgttcttgagattgctacgggagctgacgtggcggaaagcttaaacgcctttgctcgtagacgcggccggggcgtttcggtgctgagcggtagtggtttggttactaatgttactctgcgtcagcctgctgcatccggtggagttgttagtttacgtggtcagtttgagatcttgtctatgtgtggggcttttcttcctacgtctggctctcctgctgcagccgctggtttaaccatttacttagctggagctcaaggtcaagttgtgggaggtggagttgctggcccgcttattgcctctggacccgttattgtgatagctgctacgttttgcaatgccacttatgagaggttaccgattgaggaagaacaacagcaagagcagccgcttcaactagaagatgggaagaagcagaaagaagagaatgatgataacgagagtgggaataacggaaacgaaggatcgatgcagccgccgatgtataatatgcctcctaattttatcccaaatggtcatcaaatggctcaacacgacgtgtattggggtggtcctccgcctcgtgctcctccttcgtattgattagttagataggcggtggttggtgcgttctttttactggaatgattatattttccattaggatggttaggcttttgtttattaaagctatcaagtttcttttttttttacggataattcggatgacaattagctagtgtttgtttgtttgttttgtggcggcttttctgacttgactattttgatcgcggatagctttgtatgaaagtgaattgattgtagaatcgtcttttgaattttgatgttggaaaaaaccaa

SEQ ID NO: 448 - protein, 310 aa, Arabidopsis thaliana
MANPWWVGNVAIGGVESPVTSSAPSLHHRNSNNNNPPTMTRSDPRLDHDFTTNNSGSPNTQTQSQEEQNSRDEQPAVEPGSGSGSTGRRPRGRPPGSKNKPKSPVVVTKESPNSLQSHVLEIATGADVAESLNAFARRRGRGVSVLSGSGLVTNVTLRQPAASGGVVSLRGQFEILSMCGAFLPTSGSPAAAAGLTIYLAGAQGQVVGGGVAGPLIASGPVIVIAATFCNATYERLPIEEEQQQEQPLQLEDGKKQKEENDDNESGNNGNEGSMQPPMYNMPPNFIPNGHQMAQHDVYWGGPPPRAPPSY

SEQ ID NO: 449 - DNA, 1005 bp, Arabidopsis thaliana
atgatgcttgcggtggaagatgtgttaagcgaactcgccggagaagaaaggaacgagagaggattgccacctggcttccggtttcacccgacggacgaagagctcattaccttctacttagcttccaaaatcttccatggtggtctctccggcattcacatttccgaagttgatctcaaccgctgtgaaccttgggagctaccagaaatggcgaagatgggagagagagagtggtacttttatagtctaagggacaggaaatatccgacaggtttgaggactaacagagcaactactgctggatactggaaagctaccggcaaagataaggaagtcttctccggcggaggaggacagcttgttgggatgaagaagacgttggtgttctacaaaggtagggctccacgtggcctcaagactaagtgggtcatgcatgagtatcgcctcgaaaacgaccattcacaccgccacacgtgtaaggaggaatgggtgatttgcagagtgttcaataaaacaggagacagaaaaaatgttggattaatccataaccaaatcagctaccttcataaccattcactctcaacaacacatcatcatcatcatgaagccttacctttgcttatagaaccttccaacaaaaccctaaccaacttcccatcactactctacgatgatccacaccaaaactacaataataacaacttccttcatggatcatcaggccacaacatcgacgagctcaaagccttaatcaaccctgtcgtctctcagctcaacggtatcatctttccttcagggaacaacaacaacgacgaagacgacttcgactttaacctcggcgtgaaaacagagcagtcttcgaacggtaacgaaattgacgtacgagattacttggagaaccctctgtttcaggaagcgagttatggtctgttgggtttttcgtcttctcctggacctcttcacatgctactagattctccatgtcctttaggattccagctgtag

SEQ ID NO: 450 - protein, 334 aa, Arabidopsis thaliana
MMLAVEDVLSELAGEERNERGLPPGFRFHPTDEELITFYLASKIFHGGLSGIHISEVDLNRCEPWELPEMAKMGEREWYFYSLRDRKYPTGLRTNRATTAGYWKATGKDKEVFSGGGGQLVGMKKTLVFYKGRAPRGLKTKWVMHEYRLENDHSHRHTCKEEWVICRVFNKTGDRKNVGLIHNQISYLHNHSLSTTHHHHHEALPLLIEPSNKTLTNFPSLLYDDPHQNYNNNNFLHGSSGHNIDELKALINPVVSQLNGIIFPSGNNNNDEDDFDFNLGVKTEQSSNGNEIDVRDYLENPLFQEASYGLLGFSSSPGPLHMLLDSPCPLGFQL

SEQ ID NO: 451 - DNA, 1033 bp, Arabidopsis thaliana
ctctcttattctctcactcttttttttttatattcctctctctctaaatctataaaatatatttaaaaacttgatcgtatataataaagtaaataaagaataataacaaaaaaaatggagaaaagaggaggaggaagtagtggaggttcgggatcatcagcagaagcagaagtgagaaaaggaccatggacgatggaagaagatcttattcttatcaactatatcgccaaccacggcgatggtgtttggaattctctcgccaaatctgcaggtctaaaacgaaccgggaaaagttgccggctccggtggctgaactatctccgccccgacgtacgacggggaaacatcactccagaagagcaacttatcatcatggaacttcatgctaagtggggaaacaggtggtcgaaaatcgccaaacatcttccaggaagaacggacaacgagatcaaaaatttctgtaggacaagaattcaaaaatacatcaagcaatcggatgtaacaacaacatcgtccgttggatctcatcatagctcagagatcaacgatcaagctgcaagcacgtcgagccataatgtcttttgtacacaagatcaagcgatggagacttattctcctacaccgacatcatatcaacataccaatatggaattcaactatggtaactattcggccgcggcagtgacggcaaccgtggattatccagtaccgatgaccgttgatgatcaaaccggtgaaaactattggggcatggatgatatttggtcatcaatgcatttattgaatggtaattgattgatcggtggacaaaacatggaatattaattgagtattatatatgatttttaggagtactattattagtacgtgacatgtatatgtttttgcctcgttgtagaggtttggggttataattaatatataatgttatctaatatgcaaccttgatacatatttggatctttattgaacccatgttatacataaataaaattgttgaaggggtcataaaaaaaaaaaaaaaaaaaaaaaa

SEQ ID NO: 452 - protein, 226 aa, Arabidopsis thaliana
MEKRGGGSSGGSGSSAEAEVRKGPWTMEEDLILINYIANHGDGVWNSLAKSAGLKRTGKSCRLRWLNYLRPDVRRGNITPEEQLIIMELHAKWGNRWSKIAKHLPGRTDNEIKNFCRTRIQKYIKQSDVTTTSSVGSHHSSEINDQAASTSSHNVFCTQDQAMETYSPTPTSYQHTNMEFNYGNYSAAAVTATVDYPVPMTVDDQTGENYWGMDDIWSSMHLLNGN

SEQ ID NO: 453 - DNA, 1312 bp, Arabidopsis thaliana
ttctttctttctttctttctcttccaatcaagaacaaaccctagctcctctctttttctctctctacctctctttctctatcttctcttatcactacttctctcgccgatcaatcatcatgaacgatcctgataatcccgatctgagcaacgacgactctgcttggagagaactcacactcacagctcaagattctgacttcttcgaccgagacacttccaatatcctctctgacttcggttggaacctccaccactcctccgatcatcctcacagtctcagattcgactccgatttaacacaaaccaccggagtcaaacctaccaccgtcacttcttcttgttcctcatccgccgccgtttccgttgccgttacctctactaataataatccctcagctacctcaagttcaagtgaagatccggccgagaactcaaccgcctccgccgagaaaacaccaccaccggagacaccagtgaaggagaagaagaaggctcaaaagcgaattcggcaaccaagattcgcattcatgaccaagagtgatgtggataatcttgaagatggatatcgatggcgtaaatatggacaaaaagccgtcaagaatagcccattcccaaggagctactatagatgcacaaacagcagatgcacggtgaagaagagagtagaacgttcatcagatgatccatcgatagtgatcacaacatacgaaggacaacattgccatcaaaccattggattccctcgtggtggaatcctcactgcacacgacccacatagcttcacttctcatcatcatctccctcctccattaccaaatccttattattaccaagaactccttcatcaacttcacagagacaataatgctccttcaccgcggttaccccgacctactactgaagatacacctgccgtgtctactccatcagaggaaggcttacttggtgatattgtacctcaaactatgcgcaacccttgaggtaagcttggtacgtagcaatagctaaggaggtgctaactcattatatatagaagatattgcagaccagaatatgcgcagggagggtataacaatatggcgttgtaacaatggatctatatattacctcattgttgatcaatagcacaccaccggtacgtttgcaatttcttcatgtatatttcttgttatatatgtagttatatatccaggtataattttgatgtaacacaacattaatcttaatcgtggatccatcccacatttgatgcatgtatgtgcacttaagaaaaagaacatggaggaaataacgttattttttattattct

SEQ ID NO: 454 - protein, 287 aa, Arabidopsis thaliana
MNDPDNPDLSNDDSAWRELTLTAQDSDFFDRDTSNILSDFGWNLHHSSDHPHSLRFDSDLTQTTGVKPTTVTSSCSSSAAVSVAVTSTNNNPSATSSSSEDPAENSTASAEKTPPPETPVKEKKKAQKRIRQPRFAFMTKSDVDNLEDGYRWRKYGQKAVKNSPFPRSYYRCTNSRCTVKKRVERSSDDPSIVITTYEGQHCHQTIGFPRGGILTAHDPHSFTSHHHLPPPLPNPYYYQELLHQLHRDNNAPSPRLPRPTTEDTPAVSTPSEEGLLGDIVPQTMRNP

SEQ ID NO: 455 - DNA, 1067 bp, Arabidopsis thaliana
gccaaaattttaccaacatttttctcttctcatatcaaagtttctctctcatttcttcatcacacttcactgccctgttttttttcctcattttgaatagttctcaaacttatatatttttccccctgaagcctagctatttctttttatttgcattaatctcgggatccgaatcgaaaaaagcaatcagaataatagacttgtacgatacttgtgcctaagctaacacaatggcagaggaatactacagcctccgctcggagagagtaactcagcttcttgtccctaactcggagtctgactcagtgagtgacaaaagcaaagctgagcaaagcgagaagaagactaaacgtgggagagactccggtaaacaccctgtttatcgcggagtaaggatgaggaactggggaaaatgggtgtcggagattcgtgagccgaggaagaaatcacgtatttggctgggaactttcccgacgccggagatggcggcgcgtgcacacgacgtggcggctctgagcattaaaggaacggccgctatactaaacttccctgaactcgctgactcattccctcgacccgtttcattaagccctcgagacattcagacagcagctcttaaagcagctcacatggaaccgacgacgtcgttttcatcttccacgtcttcgtcgtcgtctttgtcttctacgtcttcgctcgagtctcttgtgttggtgatggacctctcgaggactgagtcggaggagctcggtgagattgtggagcttccaagtctcggggcgagttacgacgtcgactcggctaaccttgggaacgagtttgtcttctatgactcagttgactactgtttatatccgccgccgtggggacagtcgtccgaagataactatggtcacggaattagccctaattttggccatggcttgtcatgggatctctaacagtttattttgtatcattaccataatgttttgtttaaaacagtttattttgtatcattgccataatgttttgtttaatcacgtttttaaaaccctttgctgtttttgttttttttttgagttttt

SEQ ID NO: 456 - protein, 236 aa, Arabidopsis thaliana
MAEEYYSLRSERVTQLLVPNSESDSVSDKSKAEQSEKKTKRGRDSGKHPVYRGVRMRNWGKWVSEIREPRKKSRIWLGTFPTPEMAARAHDVAALSIKGTAAILNFPELADSFPRPVSLSPRDIQTAALKAAHMEPTTSFSSSTSSSSSLSSTSSLESLVLVMDLSRTESEELGEIVELPSLGASYDVDSANLGNEFVFYDSVDYCLYPPPWGQSSEDNYGHGISPNFGHGLSWDL

SEQ ID NO: 457 - DNA, 1406 bp, Arabidopsis thaliana
atacaaaactccctcttctctatcttcttcatcttaaagaaaaaataagagatattcgtaaagagagaacacaaaatttcagtttacgaaaagctagcaaagtcgagtatcgaggaataacagaataagacgtatctatccttgccttaatgttcttaccaaaagatctagtcctttctttgtatgatcgatccatcacaagcccacaacaacaacaactacatctctttctctatctctagcttctatttttaatacattcaagaatcaagaatggtacggacgccgtgttgtagagcagaagggttgaagaaaggagcatggactcaagaagaagaccaaaagcttatcgcctatgttcaacgacatggtgaaggcggttggcgaacccttccggacaaagctggactcaaaagatgtggcaaaagctgcagattgagatgggcgaattacttaagacctgacattaaacgtggagagtttagccaagacgaggaagattccatcatcaacctccacgccattcatggcaacaaatggtcggccatagctcgtaaaataccaagaagaacagacaatgagatcaagaaccattggaacactcacatcaagaaatgtctggtcaagaaaggtattgatccgttgacccacaaatcccttctcgatggagccggtaaatcatctgaccattccgcgcatcccgagaaaagcagcgttcatgacgacaaagatgatcagaattcaaataacaaaaagttgtcaggatcatcatcagctcggtttttgaacagagtagcaaacagattcggtcatagaatcaaccacaatgttctgtctgatattattggaagtaatggcctacttactagtcacactactccaactacaagtgtttcagaaggtgagaggtcaacgagttcttcctccacacatacctcttcgaatctccccatcaaccgtagcataaccgttgatgcaacatctctatcctcatccacgttctctgactcccccgacccgtgtttatacgaggaaatagtcggtgacattgaagatatgacgagattttcatcaagatgtttgagtcatgttttatctcatgaagatttattgatgtccgttgagtcttgtttggagaatacttcattcatgagggaaattacaatgatctttcaagaggataaaatcgagacgacgtcgtttaatgatagctacgtgacgccgatcaatgaagttgatgactcctgtgaagggattgacaattattttggatgagttatattgatgatgatgaaaatttgcatttggcatgtaaatcaattagagtttgatttgctatggtgtttttagtttgtgtgtgtagtgtgtttcgaccgtcaaaaaaaaaaaaaaaaaaaaaaaaaaaa

SEQ ID NO: 458 - protein, 333 aa, Arabidopsis thaliana
MVRTPCCRAEGLKKGAWTQEEDQKLIAYVQRHGEGGWRTLPDKAGLKRCGKSCRLRWANYLRPDIKRGEFSQDEEDSIINLHAIHGNKWSAIARKIPRRTDNEIKNHWNTHIKKCLVKKGIDPLTHKSLLDGAGKSSDHSAHPEKSSVHDDKDDQNSNNKKLSGSSSARFLNRVANRFGHRINHNVLSDIIGSNGLLTSHTTPTTSVSEGERSTSSSSTHTSSNLPINRSITVDATSLSSSTFSDSPDPCLYEEIVGDIEDMTRFSSRCLSHVLSHEDLLMSVESCLENTSFMREITMIFQEDKIETTSFNDSYVTPINEVDDSCEGIDNYFG

SEQ ID NO: 459 - DNA, 1011 bp, Arabidopsis thaliana
atggagttgttaatgtgttcgggtcaggccgagtcaggtggttcttcttccaccgagtcttcttcactcagtggtggactcaggtttggtcagaagatctacttcgaggatggatccggatccagaagcaagaaccgggtcaataccgttcgtaagtcgtctaccacggcgaggtgccaagtggaaggttgtagaatggatctaagcaatgttaaagcttattactcgagacacaaagtttgttgcattcactctaaatcatctaaagtcattgtctctggtcttcatcaaaggttttgtcaacaatgtagcaggtttcaccagctttctgagtttgacttggagaaaagaagttgtcgcagaagactcgcttgtcataacgaacgacgaagaaaaccacaacccacaacggctcttttcacttctcattactctcgaatcgctccatctctttacggaaaccccaatgctgcaatgattaaaagcgttttgggagatcctactgcgtggtcaaccgcaagatcagtgatgcagcggcctggaccgtggcagattaatccagttagggaaacccatccacacatgaatgttttatcacatggaagctcaagctttactacatgtccagagatgataaacaacaatagcacagattcaagctgtgctctctctcttctgtcaaactcatacccaattcatcagcagcaacttcagacaccaacaaatacatggcgaccatcttctggtttcgactcgatgatctcattctccgataaggttacaatggctcagccaccgcccatttcaacccatcagccgcccatctcaacacatcagcagtacctcagccaaacttgggaagtcatcgcgggcgaaaagagcaattcacattatatgtctcctgtgagtcaaatctcggagccagcagatttccagataagcaatggcagtgtgtcgccctattctcctccgtccttactatctcttgtgtgctacttgcggccgctatag

SEQ ID NO: 460 - protein, 336 aa, Arabidopsis thaliana
MELLMCSGQAESGGSSSTESSSLSGGLRFGQKIYFEDGSGSRSKNRVNTVRKSSTTARCQVEGCRMDLSNVKAYYSRHKVCCIHSKSSKVIVSGLHQRFCQQCSRFHQLSEFDLEKRSCRRRLACHNERRRKPQPTTALFTSHYSRIAPSLYGNPNAAMIKSVLGDPTAWSTARSVMQRPGPWQINPVRETHPHMNVLSHGSSSFTTCPEMINNNSTDSSCALSLLSNSYPIHQQQLQTPTNTWRPSSGFDSMISFSDKVTMAQPPPISTHQPPISTHQQYLSQTWEVIAGEKSNSHYMSPVSQISEPADFQISNGSVSPYSPPSLLSLVCYLRPL

SEQ ID NO: 461 - DNA, 920 bp, Arabidopsis thaliana
atggcgaagacgaaatatggagagagacataggaaagggttatggtcacctgaagaagacgagaagctaaggagcttcatcctctcttatggccattcttgctggaccactgttcccatcaaagctgggttacaaaggaatgggaagagctgcagattaagatggattaattacctaagaccagggttaaagagggatatgattagtgcagaagaagaagagactatcttgacgtttcattctcccttgggtaacaagtggtcgcaaatagctaaattcttaccgggaagaacagacaatgagataaagaactattggcactctcatttgaaaaagaaatggctcaagtctcagagcttacaagatgcaaaatctatttcccctccttcgtcttcatcatcatcacttgttgcttgtggagaaagaaatccggaaaccttgatctcgaatcacgtgttctccctccagagacttctagagaacaaatcttcatctccctcacaagaaagcaacggaaataacagccatcaatgttcttctgctcctgagattccaaggcttttcttctctgaatggctttcttcttcatatccccacaccgattattcctctgagtttaccgactctaagcacagtcaagctccaaatgtcgaagagactctctcagcttatgaagaaatgggtgatgttgatcagttccattacaacgaaatgatgatcaacaacagcaactggactcttaacgacattgtgtttggttccaaatgtaagaagcaggagcatcatatttatagagaggcttcagattgtaattcttctgctgaattcttttctccaccaacaacgacgtaaattgcgtttattgtaatgtaaatcaaatttctaaggcaaaaccggaaaaaaaaaaaaaaaaaaaaaaa

SEQ ID NO: 462 - protein, 283 aa, Arabidopsis thaliana
MAKTKYGERHRKGLWSPEEDEKLRSFILSYGHSCWTTVPIKAGLQRNGKSCRLRWINYLRPGLKRDMISAEEEETILTFHSPLGNKWSQIAKFLPGRTDNEIKNYWHSHLKKKWLKSQSLQDAKSISPPSSSSSSLVACGERNPETLISNHVFSLQRLLENKSSSPSQESNGNNSHQCSSAPEIPRLFFSEWLSSSYPHTDYSSEFTDSKHSQAPNVEETLSAYEEMGDVDQFHYNEMMINNSNWTLNDIVFGSKCKKQEHHIYREASDCNSSAEFFSPPTTT

SEQ ID NO: 463 - DNA, 1263 bp, Arabidopsis thaliana
gcaaaatcctcagatcgtcttaccttctccgaatcgatcgatttttcatggaggacgacgacgagattcagtcaattccatctccgggagattcttccctttcaccacaagctcctccttctccgccgattttgccaacaaacgacgtgacggtggccgtcgtgaagaaaccacaaccggggctttcttctcaatctccgtccatgaacgctttagcgttagtggttcatactccttctgtaaccggtggtggtggtagcggaaacagaaacggacgaggaggaggaggaggaagcggtggtggtggaggaggaagagatgattgttggagcgaagaagctacaaaggttctaatcgaagcttggggagatcgattctctgaaccaggtaaaggaactttgaagcaacaacattggaaagaagtagctgagattgtgaacaagagtcgtcaatgcaaataccctaaaactgatattcagtgtaagaacagaattgatacggtgaagaagaagtataagcaagagaaagctaagattgcttctggtgatggacctagtaaatgggttttcttcaagaagcttgagagtttgattggtggtactacaacattcattgcttcttcaaaagcttcagagaaggctcctatgggaggagctcttgggaatagccgttcgagtatgtttaaacggcaaactaaaggtaatcagattgtgcagcaacaacaagagaagagaggctctgattcgatgcggtggcattttaggaaacgtagtgcttctgagactgagtctgagtctgatcctgaacctgaggcttctcctgaggaatctgctgagagtctcccacctttgcaaccgattcaaccgctttcgtttcatatgccaaagcggttgaaggtggataagagtggaggtggagggagtggagttggagatgtggcgagggcgatacttggatttacggaagcttatgagaaggcggaaactgctaagcttaagttaatggcggaactggaaaaggagaggatgaaatttgctaaagagatggagttgcagagaatgcagttcttgaaaactcaattggagataacacagaacaatcaagaagaggaagagaggagcaggcagcgaggagaaaggaggatcgttgatgatgatgatgatcgcaatggcaagaataacggcaatgtaagtagctgacaattgaacacacaaatgttcctatgatatttgctatgataagctggattttaggttttgatgg

SEQ ID NO: 464 - protein, 383 aa, Arabidopsis thaliana
MEDDDEIQSIPSPGDSSLSPQAPPSPPILPTNDVTVAVVKKPQPGLSSQSPSMNALALVVHTPSVTGGGGSGNRNGRGGGGGSGGGGGGRDDCWSEEATKVLIEAWGDRFSEPGKGTLKQQHWKEVAEIVNKSRQCKYPKTDIQCKNRIDTVKKKYKQEKAKIASGDGPSKWVFFKKLESLIGGTTTFIASSKASEKAPMGGALGNSRSSMFKRQTKGNQIVQQQQEKRGSDSMRWHFRKRSASETESESDPEPEASPEESAESLPPLQPIQPLSFHMPKRLKVDKSGGGGSGVGDVARAILGFTEAYEKAETAKLKLMAELEKERMKFAKEMELQRMQFLKTQLEITQNNQEEEERSRQRGERRIVDDDDDRNGKNNGNVSS

SEQ ID NO: 465 - DNA, 1414 bp, Arabidopsis thaliana
cacgagcttctgactcagatccggcgatatcgaattccatggaggacgatgaagacatccgatctcagggttccgattcacctgatccgtcttcctccccgccggcgggacgaatcacggttacggtggcttcggcaggtccgccttcttattctctgactcctccgggtaattcgtcgcagaaggatccggatgcgttggctctggcgctgcttccgattcaggccagcggtggagggaataacagcagtgggagaccaaccggcggcggcgggagggaggattgttggagcgaagcagctacggctgtgttgattgatgcgtggggtgagagatacttggagcttagcagagggaatctgaagcagaagcactggaaagaggtggctgagattgtgagcagcagagaggattacggtaaaattcccaaaactgatatacagtgtaagaataggatcgatacggtgaagaagaagtataaacaagagaaggtgagaatcgctaacggcggtggccgtagcagatgggtgttcttcgacaagcttgaccgtctgattggatcaacggcgaagatcccgacggcaacttctggagtcagcggtcctgtcggaggattgcataagattcctatgggtattccaatgggaagtcgttcgaatctgtaccatcagcaagctaaggctgcaacaccgcctttcaataatcttgaccggttaattggagctacggctagagtctcagctgcttctttcggtggcagtggtggaggaggcggaggaggatctgtcaatgtacctatgggaattccgatgagtagccgttcagctccgtttggacagcaagggaggactctgccacagcaaggtaggacactgccacagcaacagcagcaagggatgatggtgaaaaggtgtagtgagtcgaaacgctggcgtttcaggaagaggaacgcttctgattcagactcggaatctgaagcagcaatgtcagatgattccggtgacagtttaccacctcctcctctgtcgaagaggatgaagacggaggagaagaagaagcaagatggtgatggagtggggaacaaatggagggagctgactcgggcaatcatgagattcggtgaagcttatgagcaaacagagaatgcgaaactgcaacaggtggttgagatggagaaagagaggatgaagttcttgaaggagcttgagttgcagagaatgcagttctttgtgaagactcaattggagatatcacaacttaagcagcaacatgggaggagaatgggaaacaccagtaatgatcatcatcacagccgcaagaacaacatcaatgcgattgtcaacaacaacaacgatttgggtaataactagaatttagtgatgcagtgtcgtaattgatatattttagatttgag

SEQ ID NO: 466 - protein, 443 aa, Arabidopsis thaliana
MEDDEDIRSQGSDSPDPSSSPPAGRITVTVASAGPPSYSLTPPGNSSQKDPDALALALLPIQASGGGNNSSGRPTGGGGREDCWSEAATAVLIDAWGERYLELSRGNLKQKHWKEVAEIVSSREDYGKIPKTDIQCKNRIDTVKKKYKQEKVRIANGGGRSRWVFFDKLDRLIGSTAKIPTATSGVSGPVGGLHKIPMGIPMGSRSNLYHQQAKAATPPFNNLDRLIGATARVSAASFGGSGGGGGGGSVNVPMGIPMSSRSAPFGQQGRTLPQQGRTLPQQQQQGMMVKRCSESKRWRFRKRNASDSDSESEAAMSDDSGDSLPPPPLSKRMKTEEKKKQDGDGVGNKWRELTRAIMRFGEAYEQTENAKLQQVVEMEKERMKFLKELELQRMQFFVKTQLEISQLKQQHGRRMGNTSNDHHHSRKNNINAIVNNNNDLGNN

SEQ ID NO: 467 - DNA, 957 bp, Arabidopsis thaliana
cggacgcgtgggcaaatattaaaataaaaagtgtcggtgaattctcaatctttgtcttctttcgtcgtctctttaaaactcctccgtccctccttattatgtaaccgtctcgccgtcaaattttcaaaatctctccctccgttcataaacccagatcgaaatttatggttttgtaatttttttaccggcggttatggagacggaagcggcggtgacagcgacggttacggcggcgacgatggggattgggacgaggaagagagatctgaaaccgtataaaggaatacgaatgaggaaatgggggaaatgggtggcggagatacgggaaccgaataagagatcaaggatctggttaggttcttatgcgacgcctgaagcggcggcgagagcttacgacactgctgttttttacctccgtggtccttcagcgaggcttaattttccggagcttttggctggacttactgtttctaacggcggaggaagaggtggtgatttatcggcggcgtatattaggagaaaagcggcggaggttggtgctcaggttgatgcgcttggagcgacggtggttgtgaataccggcggcgagaatcgcggtgattacgagaagattgagaattgtcgtaagagcggtaacgggtcattggaacgggtcgatttgaataaattacccgacccggaaaattcggatggtgatgatgacgaatgtgtgaaaagaagatagaaaaaataaaaagtagttgtagaaggagagacgagaatgtttgtctttaagatgcgctgttgccgctaacatgcgctttcgattttagtgttaaacatgcgcctccattgtttttgggttttgttttcgtcgtcgataatcaaagattttaaaacacaattctcaaatttttcacttgttacaaactagatttgcatgatctttgtattaacgaataacgattaagtcctaaa

SEQ ID NO: 468 - protein, 176 aa, Arabidopsis thaliana
METEAAVTATVTAATMGIGTRKRDLKPYKGIRMRKWGKWVAEIREPNKRSRIWLGSYATPEAAARAYDTAVFYLRGPSARLNFPELLAGLTVSNGGGRGGDLSAAYIRRKAAEVGAQVDALGATVVVNTGGENRGDYEKIENCRKSGNGSLERVDLNKLPDPENSDGDDDECVKRR

SEQ ID NO: 469 - DNA, 999 bp, Arabidopsis thaliana
atgaggatggagatggtgcatgctgacgtggcgtctctctccataacaccttgcttcccgtcttctttgtcttcgtcctcacatcatcactataaccaacaacaacattgtatcatgtcggaagatcaacaccattcgatggatcagaccacttcatcggactacttctctttaaatatcgacaatgctcaacatctccgtagctactacacaagtcatagagaagaagacatgaaccctaatctaagtgattacagtaattgcaacaagaaagacacaacagtctatagaagctgtggacactcgtcaaaagcttcggtgtctagaggacattggagaccagctgaagatactaagctcaaagaactagtcgccgtctacggtccacaaaactggaacctcatagctgagaagctccaaggaagatccgggaaaagctgtaggcttcgatggtttaaccaactagacccaaggataaatagaagagccttcactgaggaagaagaagagaggctaatgcaagctcataggctttatggtaacaaatgggcgatgatagcgaggcttttccctggtaggactgataattctgtgaagaaccattggcatgttataatggctcgcaagtttagggaacaatcttcttcttaccgtaggaggaagacgatggtttctcttaagccactcattaaccctaatcctcacattttcaatgattttgaccctacccggttagctttgacccaccttgctagtagtgaccataagcagcttatgttaccagttccttgcttcccaggttatgatcatgaaaatgagagtccattaatggtggatatgttcgaaacccaaatgatggttggcgattacattgcatggacacaagaggcaactacattcgatttcttaaaccaaaccgggaagagtgagatatttgaaagaatcaatgaggagaagaaaccaccatttttcgattttcttgggttggggacggtgtga

SEQ ID NO: 470 - protein, 332 aa, Arabidopsis thaliana
MRMEMVHADVASLSITPCFPSSLSSSSHHHYNQQQHCIMSEDQHHSMDQTTSSDYFSLNIDNAQHLRSYYTSHREEDMNPNLSDYSNCNKKDTTVYRSCGHSSKASVSRGHWRPAEDTKLKELVAVYGPQNWNLIAEKLQGRSGKSCRLRWFNQLDPRINRRAFTEEEEERLMQAHRLYGNKWAMIARLFPGRTDNSVKNHWHVIMARKFREQSSSYRRRKTMVSLKPLINPNPHIFNDFDPTRLALTHLASSDHKQLMLPVPCFPGYDHENESPLMVDMFETQMMVGDYIAWTQEATTFDFLNQTGKSEIFERINEEKKPPFFDFLGLGTV

SEQ ID NO: 471 - DNA, 1026 bp, Arabidopsis thaliana
atgggttcttcgtcgaacggaggagtgccacctggtttccggtttcatccgacggacgaagagcttctccattactacttgaagaagaaaatctcttaccaaaagtttgagatggaagtcatcagagaggttgacttaaacaagcttgagccttgggatttgcaagagagatgcaagataggatcaacaccacaaaacgaatggtacttcttcagccacaaggacaggaaatatccgacggggtcaaggaccaaccgtgctactcatgcagggttctggaaggcgacgggacgtgacaagtgcataaggaactcttacaaaaagataggaatgaggaagacacttgtgttctacaaaggtagagctcctcatggccaaaagactgattggatcatgcatgagtaccgtcttgaagacgctgatgatcctcaagccaaccctagtgaagatggatgggtggtatgtagagtgtttatgaagaaaaatttgttcaaggtagtaaatgaaggtagctcaagcattaactcattggaccaacacaaccatgacgcatctaacaacaaccatgcacttcaagctcgtagctttatgcaccgagacagtccataccagctagtacgtaaccacggagccatgacattcgaacttaacaagcctgaccttgctcttcatcaatacccaccaatcttccacaagccaccttcacttggatttgactactcttcaggacttgcaagggacagtgagagtgcggctagtgaagggttacaataccagcaagcgtgtgagccgggtttagacgttggtacatgtgagacagtggctagtcataatcatcaacaaggtctaggtgaatgggcaatgatggatagacttgtgacttgtcacatgggaaatgaagattcctctagagggattacgtatgaggatggtaacaacaattcgtcctctgtggttcagccagttcccgcgacgaaccagctaacattgcgtagtgagatggatttctggggttattctaaatag

SEQ ID NO: 472 - protein, 341 aa, Arabidopsis thaliana
MGSSSNGGVPPGFRFHPTDEELLHYYLKKKISYQKFEMEVIREVDLNKLEPWDLQERCKIGSTPQNEWYFFSHKDRKYPTGSRTNRATHAGFWKATGRDKCIRNSYKKIGMRKTLVFYKGRAPHGQKTDWIMHEYRLEDADDPQANPSEDGWVVCRVFMKKNLFKVVNEGSSSINSLDQHNHDASNNNHALQARSFMHRDSPYQLVRNHGAMTFELNKPDLALHQYPPIFHKPPSLGFDYSSGLARDSESAASEGLQYQQACEPGLDVGTCETVASHNHQQGLGEWAMMDRLVTCHMGNEDSSRGITYEDGNNNSSSVVQPVPATNQLTLRSEMDFWGYSK

SEQ ID NO: 473 - DNA, 832 bp, Arabidopsis thaliana
aacttagtgccacttagacacaataagaaaaccgttaacaagaagaaaaaaaaaagatcgaaaatggaatatcaaactaacttcttaagtggagagttttccccggagaactcttcttcaagctcatggagctcacaagaatcattcttgtgggaagagagtttcttacatcaatcatttgaccaatccttccttttatctagccctactgataactactgtgatgacttctttgcatttgaatcatcaatcataaaagaagaaggaaaagaagccaccgtggcggccgaggaggaggagaagtcatacagaggagtgaggaaacggccgtgggggaaattcgcggccgagataagagactcaacgaggaaagggataagagtgtggcttgggacattcgacaccgcggaggcggcggctctcgcttatgatcaggcggctttcgctttgaaaggcagcctcgcagtactcaatttccccgcggatgtcgttgaagaatctctccggaagatggagaatgtgaatctcaatgatggagagtctccggtgatagccttgaagagaaaacactccatgagaaaccgtcctagaggaaagaagaaatcttcttcttcttcgacgttgacatcttctccttcttcctcctcctcctattcatcttcttcgtcttcttcttctttgtcgtcaagaagtagaaaacagagtgttgttatgacgcaagaaagtaatacaacacttgtggttcttgaggatttaggtgctgaatacttagaagagcttatgagatcatgttcttgataatctctgcttctacaatttttatgtaatttga

SEQ ID NO: 474 - protein, 244 aa, Arabidopsis thaliana
MEYQTNFLSGEFSPENSSSSSWSSQESFLWEESFLHQSFDQSFLLSSPTDNYCDDFFAFESSIIKEEGKEATVAAEEEEKSYRGVRKRPWGKFAAEIRDSTRKGIRVWLGTFDTAEAAALAYDQAAFALKGSLAVLNFPADVVEESLRKMENVNLNDGESPVIALKRKHSMRNRPRGKKKSSSSSTLTSSPSSSSSYSSSSSSSSLSSRSRKQSVVMTQESNTTLVVLEDLGAEYLEELMRSCS

SEQ ID NO: 475 - DNA, 841 bp, Arabidopsis thaliana
tttcaacagtaatttaagttaaccggagtctctttttgttttccggcgaatttttggtactttgagttatgaataatgatgatattattctggcggagatgaggcctaagaagcgtgcgggaaggagagtgtttaaggagacacgtcacccagtttacagaggcataaggcggaggaacggtgacaaatgggtctgcgaagtcagagaaccgacgcaccaacgccgcatttggctcgggacttatcccacagcagatatggcagcgcgtgcacacgacgtggcggttttagctctgcgtgggagatccgcatgtttgaatttcgccgactccgcttggcggcttccggtgccggaatccaatgatccggatgtgataagaagagttgcggcggaagctgcggagatgtttaggccggtggatttagaaagtggaattacggttttgccttgtgcgggagatgatgtggatttgggttttggttcgggttccggctctggttcgggatcggaggagaggaattcttcttcgtatggatttggagactacgaagaagtctcaacgacgatgatgagactcgcggaggggccactaatgtcgccgccgcgatcgtatatggaagacatgactcctactaatgtttacacggaagaagagatgtgttatgaagatatgtcattgtggagttacagatattaagtgggactcacatatctactatacataatatttagcttttatgtaagaggtatttatgtgagttttaagattgtagatgtgtcccaggcgttagaagtttccttgatggtatggaatctttgtacctataaaattataaaatt

SEQ ID NO: 476 - protein, 209 aa, Arabidopsis thaliana
MNNDDIILAEMRPKKRAGRRVFKETRHPVYRGIRRRNGDKWVCEVREPTHQRRIWLGTYPTADMAARAHDVAVLALRGRSACLNFADSAWRLPVPESNDPDVIRRVAAEAAEMFRPVDLESGITVLPCAGDDVDLGFGSGSGSGSGSEERNSSSYGFGDYEEVSTTMMRLAEGPLMSPPRSYMEDMTPTNVYTEEEMCYEDMSLWSYRY

SEQ ID NO: 477 - DNA, 908 bp, Arabidopsis thaliana
caaagtgaaaacataagatcatcttcttcgttgatagatcaatataggaactccagaagagaatcttgatcaattaagtatcatgtctcacatcgctgttgaaaggaatcgaagaaggcaaatgaacgagcatcttaaatcccttcgttctttgactccttgtttctacatcaaaaggggagatcaagcttcgatcatcggaggagtgatagagttcatcaaagagttgcagcaattggttcaagttcttgagtccaagaaacgtcgaaagaccctaaaccgaccatctttcccttatgatcaccagacaatcgagccatccagtttaggagccgccactacccgagtaccgtttagtcgaatcgaaaatgtgatgaccacaagtactttcaaggaagtaggagcatgctgtaactcccctcatgctaacgtagaagcaaagatttcaggttctaatgttgtattgagagttgtctctaggcgaatcgtggggcagctcgtaaagatcatctctgtcttagagaagctatcttttcaagttcttcacctcaatattagtagcatggaggagactgtcttatactttttcgttgttaagataggattggagtgtcacttaagcttggaggagctaactcttgaagttcagaaaagctttgtgtctgatgaagtgatcgtctctaccaattaaaaacaaaattctacatgtactagagcgtgtatcgttttttgggattaataatcatataatcgttacatgagccttgatactttgctagaaataagctcctctaaacaaaaccttctttttaaaaaaacacacttatgttttacttagtttgttgttgtatccgaagttgatcaacgttgtaatttcccacaataaatcatgacattttatatgctct

SEQ ID NO: 478 - protein, 202 aa, Arabidopsis thaliana
MSHIAVERNRRRQMNEHLKSLRSLTPCFYIKRGDQASIIGGVIEFIKELQQLVQVLESKKRRKTLNRPSFPYDHQTIEPSSLGAATTRVPFSRIENVMTTSTFKEVGACCNSPHANVEAKISGSNVVLRVVSRRIVGQLVKIISVLEKLSFQVLHLNISSMEETVLYFFVVKIGLECHLSLEELTLEVQKSFVSDEVIVSTN

SEQ ID NO: 479 - DNA, 1197 bp, Arabidopsis thaliana
aaggagttttgcatactcaccaagccacaatcatttctctcttctctatctctctggttttgaatcggcgacgactgagtcaactcggtgttgttactggtttcgtcgtatgtgttgtaactgattaagttgatggatccgagtgggatgatgaacgaaggaggaccgtttaatctagcggagatctggcagtttccgttgaacggagtttcaaccgccggagattcttctagaagaagcttcgttggaccgaatcagttcggtgatgctgatctaaccacagctgctaacggtgatccagcgcgtatgagtcacgcgttgtctcaggcggttattgaaggtatctccggcgcttggaaacggagggaagatgagtctaagtcggcgaagatcgtctccaccattggcgctagtgaaggtgagaacaaaagacagaagatagatgaagtgtgtgatgggaaagcagaagcagaatcgctaggaacagagacggaacaaaagaagcaacagatggaaccaacgaaagattatattcatgttcgagctagaagaggtcaagctactgatagtcacagtttagctgaaagagcgagaagagagaaaataagtgagcggatgaaaatcttgcaagatcttgttccgggatgtaacaaggttattggaaaagcacttgttctagatgagataattaactatatacaatcattgcaacgtcaagttgagttcttatcgatgaagcttgaagcagtcaactcaagaatgaaccctggtatcgaggtttttccacccaaagaggtgatgattctcatgatcatcaactcaatcttctccatttttttcacaaaacaatacatgtttctatcgaggtattctcggggtaggagtctcgatgtttatgcggttcggtcatttaagcattgcaataaacggagtgacctctgtttttgctcctgctccccaaaaacagaacttaagacaactatattttcacaaaacatgacatgtttctgtcgatattctcgagtaggagtcgctattagttcatctaagcattgcaatgaaccgtttggtcagcaagcgtttgagaatccggagatacagttcgggtcgcagtctacgagggaatacagtagaggagcatcaccagagtggttgcacatgcagataggatcaggtggtttcgaaagaacgtcttga

SEQ ID NO: 480 - protein, 354 aa, Arabidopsis thaliana
MDPSGMMNEGGPFNLAEIWQFPLNGVSTAGDSSRRSFVGPNQFGDADLTTAANGDPARMSHALSQAVIEGISGAWKRREDESKSAKIVSTIGASEGENKRQKIDEVCDGKAEAESLGTETEQKKQQMEPTKDYIHVRARRGQATDSHSLAERARREKISERMKILQDLVPGCNKVIGKALVLDEIINYIQSLQRQVEFLSMKLEAVNSRMNPGIEVFPPKEVMILMIINSIFSIFFTKQYMFLSRYSRGRSLDVYAVRSFKHCNKRSDLCFCSCSPKTELKTTIFSQNMTCFCRYSRVGVAISSSKHCNEPFGQQAFENPEIQFGSQSTREYSRGASPEWLHMQIGSGGFERTS

SEQ ID NO: 481 - DNA, 1080 bp, Arabidopsis thaliana
atgataagcaaggatccaatatcgagtttacctccagggtttcgatttcatccaacagatgaagaactcattctccattacctaaggaagaaagtttcctcttccccagtcccgctttcgattatcgccgatgtcgatatctacaaatccgatccatgggatttaccagctaaggctccatttggggagaaagagtggtattttttcagtccgagggataggaaatatccaaacggagcaagaccaaacagagcagctgcgtctggatattggaaagcaaccggaacagataaattgattgcggtaccaaatggtgaagggtttcatgaaaacattggtataaaaaaagctcttgtgttttatagaggaaagcctccaaaaggtgttaaaaccaattggatcatgcatgaatatcgtcttgccgattcattatctcccaaaagaattaactcttctaggagcggtggtagcgaagttaataataattttggagataggaattctaaagaatattcgatgagactggatgattgggttctttgccggatttacaagaaatcacacgcttcattgtcatcacctgatgttgctttggtcacaagcaatcaagagcatgaggaaaatgacaacgaaccattcgtagaccgcggaacctttttgccaaatttgcaaaatgatcaaccccttaaacgccagaagtcttcttgttcgttctcaaacttactagacgctacagatttgacgtttctcgcaaattttctaaacgaaaccccggaaaatcgttctgaatcagatttttctttcatgattggcaatttctctaatcctgacatttacggaaaccattacttggatcagaagttaccgcagttgagctctcccacttcagagacaagcggcatcggaagcaaaagagagagagtggattttgcggaagaaacgataaacgcttcgaagaagatgatgaacacatatagttacaataatagtatagatcaaatggatcatagtatgatgcaacaacctagtttcctgaaccaggaactcatgatgagttctcaccttcaatatcaaggctag

SEQ ID NO: 482 - protein, 359 aa, Arabidopsis thaliana
MISKDPISSLPPGFRFHPTDEELILHYLRKKVSSSPVPLSIIADVDIYKSDPWDLPAKAPFGEKEWYFFSPRDRKYPNGARPNRAAASGYWKATGTDKLIAVPNGEGFHENIGIKKALVFYRGKPPKGVKTNWIMHEYRLADSLSPKRINSSRSGGSEVNNNFGDRNSKEYSMRLDDWVLCRIYKKSHASLSSPDVALVTSNQEHEENDNEPFVDRGTFLPNLQNDQPLKRQKSSCSFSNLLDATDLTFLANFLNETPENRSESDFSFMIGNFSNPDIYGNHYLDQKLPQLSSPTSETSGIGSKRERVDFAEETINASKKMMNTYSYNNSIDQMDHSMMQQPSFLNQELMMSSHLQYQG

SEQ ID NO: 483 - DNA, 975 bp, Arabidopsis thaliana
atggataatataatgcaatcgtcaatgccaccgggattccgatttcatccgacagaggaagagcttgtgggttattacctagataggaagatcaattcaatgaagagtgctttagatgtcattgtagagattgatctctacaaaatggagccatgggatatacaagcgaggtgtaaactagggtatgaagagcaaaacgagtggtacttctttagtcataaggacaggaagtaccctaccgggactaggaccaaccgagccactgcggctgggttctggaaagccacgggtagagacaaggcggtactatcaaaaaacagtgtcatcggaatgcggaagacacttgtctactacaagggtcgagctcctaatggaagaaagtccgattggatcatgcacgaataccgtctccaaaactccgagcttgccccggttcaggaggaaggctgggtggtgtgtcgagcatttaggaagccaattccaaaccagaggccattagggtacgagccatggcagaaccagctctaccacgtcgaaagtagtaacaactactcatcttcagtgacaatgaacacgagtcatcatatcggtgcatcttcatcaagtcataaccttaatcaaatgctcatgagcaataaccactacaatcctaataatacatcctcatcgatgcatcaatatggcaacattgagctcccgcagttggacagcccgagcttgtcgcctagtttagggacgaataaagatcagaacgagagtttcgagcaagaagaagagaagagctttaactgtgtggattggagaacactagataccttgcttgagacacaagtcatacatccgcataaccctaatattcttatgttcgaaacgcagtcgtataatccggcgccaagcttcccttccatgcatcaaagctataatgaggtcgaagctaatattcatcattctcttggatgcttccctgactcgtaa

SEQ ID NO: 484 - protein, 324 aa, Arabidopsis thaliana
MDNIMQSSMPPGFRFHPTEEELVGYYLDRKINSMKSALDVIVEIDLYKMEPWDIQARCKLGYEEQNEWYFFSHKDRKYPTGTRTNRATAAGFWKATGRDKAVLSKNSVIGMRKTLVYYKGRAPNGRKSDWIMHEYRLQNSELAPVQEEGWVVCRAFRKPIPNQRPLGYEPWQNQLYHVESSNNYSSSVTMNTSHHIGASSSSHNLNQMLMSNNHYNPNNTSSSMHQYGNIELPQLDSPSLSPSLGTNKDQNESFEQEEEKSFNCVDWRTLDTLLETQVIHPHNPNILMFETQSYNPAPSFPSMHQSYNEVEANIHHSLGCFPDS

SEQ ID NO: 485 - DNA, 1012 bp, Arabidopsis thaliana
ccagatttaatttgagactctcaaagaaacaccatggaagaagagcaacctccggccaagaaacgaaacatggggagatctagaaaaggttgcatgaaaggtaaaggcggtccagagaacgccacgtgtactttccgtggagttaggcaacggacttggggtaaatgggtggctgagatccgtgagcctaaccgtgggactcgtctctggctcggcacgtttaatacctcggtcgaggccgccatggcttacgatgaagccgctaagaaactctatggacacgaggctaaactcaacttggtgcacccacaacaacaacaacaagtagtagtgaacagaaacttgtctttttctggccacgggtcgggttcttgggcttataataagaagctcgatatggttcatgggttggaccttggtctcggccaggcaagttgttcacgaggttcttgctcagagagatcgagttttctacaagaagatgatgatcatagtcataatcgatgttcgtcttcaagtggttcgaatctttgttggttattacctaaacaaagtgattcacaagatcaagagaccgttaatgctacgactagttatggcggtgaaggcggtggtggctctacgttaacgttttcgaccaatttgaaaccaaagaatttgatgagtcagaattatggattatacaatggagcttggtctaggtttcttgtggggcaagaaaagaagacggaacatgacgtgtcatcgtcgtgtggatcgtcggacaacaaggagagtatgttggttcctagttgcggcggagagaggatgcataggccggagttggaagagcgaacaggatatttggaaatggatgatcttttggagattgatgatttaggtttgttgattggcaaaaatggagatttcaagaattggtgttgtgaagagtttcaacatccatggaattggttctgagagtttttatttattactattatttatcatacatatttcttatatttgacttagg

SEQ ID NO: 486 - protein, 307 aa, Arabidopsis thaliana
MEEEQPPAKKRNMGRSRKGCMKGKGGPENATCTFRGVRQRTWGKWVAEIREPNRGTRLWLGTFNTSVEAAMAYDEAAKKLYGHEAKLNLVHPQQQQQVVVNRNLSFSGHGSGSWAYNKKLDMVHGLDLGLGQASCSRGSCSERSSFLQEDDDHSHNRCSSSSGSNLCWLLPKQSDSQDQETVNATTSYGGEGGGGSTLTFSTNLKPKNLMSQNYGLYNGAWSRFLVGQEKKTEHDVSSSCGSSDNKESMLVPSCGGERMHRPELEERTGYLEMDDLLEIDDLGLLIGKNGDFKNWCCEEFQHPWNWF

SEQ ID NO: 487 - DNA, 1379 bp, Arabidopsis thaliana
aaagaaaagaaaaataaagataatgaggacgaagactaagttagtactcatacctgatagacactttcggagagccacattcaggaagaggaatgcagggataaggaagaaactccacgagctgacaactctctgtgacatcaaagcatgtgcggtaatctacagtccgttcgagaatccaacggtgtggccgtcaaccgaaggtgttcaagaggtgatttcggagttcatggagaagccggcgacagaacggtccaagacgatgatgagtcatgagactttcttgcgggaccaaatcaccaaagaacaaaacaaactagagagtctacgtcgtgaaaaccgagaaactcagcttaagcattttatgtttgattgcgttggaggcaagatgagtgagcaacagtatggtgcaagggaccttcaagatttaagtctttttactgatcaatatcttaatcagcttaatgccaggaagaagttccttacagaatatggtgagtcttcttcttctgttcctcctctgtttgatgttgcgggtgccaatcctcctgttgttgcagatcaagctgcggtaactgttcctcctttgtttgctgttgcgggtgccaatcttcctgttgttgctgatcaagctgcggtaactgttcctcctctgtttgctgttgcgggtgccaatcttcctgttgttgcagatcaagctgcggttaatgttcctactggatttcataacatgaatgtgaaccagaatcagtatgagccggttcagccctatgtccctactggttttagtgatcatattcaatatcagaatatgaacttcaatcaaaaccaacaagagccggttcattaccaggctcttgctgttgcgggtgccggtcttcctatgactcagaatcagtatgagcccgttcactaccagagtcttgctgtcgcgggtggcggtcttcctatgagtcagttgcagtatgagccggttcagccttatatccctactgtttttagtgataatgttcaatatcagcatatgaatttgtatcaaaatcaacaagagccggttcactaccaagctcttggtgttgcaggtgccggtcttcctatgaatcagaatcagtatgagccggttcagccctatgtccctactggttttagtgatcattttcagtttgagaatatgaatttgaatcaaaatcaacaggagccggttcaataccaagctcctgttgattttaatcatcagattcaacaaggaaactatgatatgaatttgaaccagaatatgagtttggatccaaatcagtatccgtttcaaaatgatccattcatgaatatgttgacagaatatccttatgaataagcgggttatgttggagagcatgcac

SEQ ID NO: 488 - protein, 443 aa, Arabidopsis thaliana
MRTKTKLVLIPDRHFRRATFRKRNAGIRKKLHELTTLCDIKACAVIYSPFENPTVWPSTEGVQEVISEFMEKPATERSKTMMSHETFLRDQITKEQNKLESLRRENRETQLKHFMFDCVGGKMSEQQYGARDLQDLSLFTDQYLNQLNARKKFLTEYGESSSSVPPLFDVAGANPPVVADQAAVTVPPLFAVAGANLPVVADQAAVTVPPLFAVAGANLPVVADQAAVNVPTGFHNMNVNQNQYEPVQPYVPTGFSDHIQYQNMNFNQNQQEPVHYQALAVAGAGLPMTQNQYEPVHYQSLAVAGGGLPMSQLQYEPVQPYIPTVFSDNVQYQHMNLYQNQQEPVHYQALGVAGAGLPMNQNQYEPVQPYVPTGFSDHFQFENMNLNQNQQEPVQYQAPVDFNHQIQQGNYDMNLNQNMSLDPNQYPFQNDPFMNMLTEYPYE

SEQ ID NO: 489 - DNA, 1194 bp, Arabidopsis thaliana
ctctgtctctcgtatctttctactactctgtttcttgaattctaatgaacaacatcgacgacgcaaagacggagacttcagtgtcttcaggttcaagcgactctttcttgcctctcaagaaacgcatgagacttgatgacgaaccagaaaacgccctagtggtttcgtcttcaccaaagacggttgtggcttctggcaatgtcaagtacaaaggagtcgttcagcaacagaacggtcattggggtgcccagatttacgcagaccacaaaaggatttggcttggaactttcaaatccgctgatgaagccgccacggcttacgatagtgcatctatcaaactccgaagctttgacgctaactcgcaccggaacttcccttggtctacaatcactctcaacgaaccagactttcaaaattgctacacaacagagactgtgttgaacatgatcagagacggttcgtaccaacacaaattcagagattttctcagaatcagatctcagattgttgcgagtatcaacatcgggggaccaaaacaagcccgaggagaagtgaatcaagaatcagacaagtgtttttcttgcacacagctttttcagaaggaattgacaccgagcgatgtagggaaactaaataggcttgtgatacctaaaaagtatgcagtgaagtatatgcctttcataagcgctgatcaaagcgagaaagaagagggtgaaatagtaggatctgtggaagatgtggaggttgtgttttacgacagagcaatgagacaatggaagtttaggtattgttactggaaaagtagccagagctttgtcttcaccagaggatggaatagtttcgtgaaggagaagaatctcaaggagaaggatgttattgccttctacacttgcgatgtcccgaacaatgtgaagacattagaaggtcaaagaaagaacttcttgatgatcgatgttcattgcttttcagacaacggttccgtggtagctgaggaagtaagtatgacggttcatgacagttcagtgcaagtaaagaaaacagaaaacttggttagctccatgttagaagataaagaaaccaaatcagaggagaacaaaggagggtttatgctgtttggtgtaaggatcgaatgtccttagggaatttttctttaaaagtttcttacttcaactagaacttgttttacttgtacct

SEQ ID NO: 490 - protein, 364 aa, Arabidopsis thaliana
MNNIDDAKTETSVSSGSSDSFLPLKKRMRLDDEPENALVVSSSPKTVVASGNVKYKGVVQQQNGHWGAQIYADHKRIWLGTFKSADEAATAYDSASIKLRSFDANSHRNFPWSTITLNEPDFQNCYTTETVLNMIRDGSYQHKFRDFLRIRSQIVASINIGGPKQARGEVNQESDKCFSCTQLFQKELTPSDVGKLNRLVIPKKYAVKYMPFISADQSEKEEGEIVGSVEDVEVVFYDRAMRQWKFRYCYWKSSQSFVFTRGWNSFVKEKNLKEKDVIAFYTCDVPNNVKTLEGQRKNFLMIDVHCFSDNGSVVAEEVSMTVHDSSVQVKKTENLVSSMLEDKETKSEENKGGFMLFGVRIECP

SEQ ID NO: 491 - DNA, 881 bp, Arabidopsis thaliana
caaaataccaaaaacaaaacattttttttaatcttcccaccaatttttttctctttctctcgttacattaaattatctttagatgcaagactcttcctctcacgaatcgcaacgtaacctccggtcaccggtgccggagaaaaccggaaagagttctaagactaaaaatgagcaaaaaggtgtttctaaacaaccaaattttcgtggggtcagaatgagacaatggggaaaatgggtgtctgaaattagagaaccaagaaagaaatcaagaatatggctcggtactttctctacgccggagatggcggcgcgtgcacacgacgtggcggctttagccatcaaaggtggctctgcccaccttaatttcccggagctagcttaccatttgccgagaccggctagcgcggaccctaaagacattcaagaagccgccgccgcagcagctgccgttgactggaaagcaccggagtctccgtctagcaccgtgacgtcatctccagtcgccgacgacgctttctccgatcttcctgatcttttgcttgacgtgaatgatcacaacaaaaacgatggattctgggactcgtttccgtacgaagatcctttcttcttggaaaattactagaaggcaaattcttgccggcgaacggattttccggtggtttcccggtaaataagaagacgatgtcgttttgtaccttttttgtctacgatgggaaatttcttttttttttacgtgtgagtaaaagtttccgaatgtgtgatgtgtaagtaagtacaggttatttaatttcttttttttgtacaaatacgtacgtcattaccaaaaagttttcatttattgtgcttttatcttccaaattcattaaaaaaaaaaaaaaaaa

SEQ ID NO: 492 - protein, 179 aa, Arabidopsis thaliana
MQDSSSHESQRNLRSPVPEKTGKSSKTKNEQKGVSKQPNFRGVRMRQWGKWVSEIREPRKKSRIWLGTFSTPEMAARAHDVAALAIKGGSAHLNFPELAYHLPRPASADPKDIQEAAAAAAAVDWKAPESPSSTVTSSPVADDAFSDLPDLLLDVNDHNKNDGFWDSFPYEDPFFLENY

SEQ ID NO: 493 - DNA, 894 bp, Arabidopsis thaliana
atggaagcgaagaaggaagagataaagaaaggtccatggaaagccgaagaagacgaagtactcatcaaccatgtcaagagatacggtcctcgtgattggagctccattcgatccaaaggtcttcttcaacgcaccggcaaatcctgtcgtcttcgttgggtcaataaactccgtcccaatctcaaaaatggatgcaagttctcggctgacgaagagaggactgtgattgagttacaatctgagtttggtaacaaatgggcgagaatcgctacgtatctaccgggaagaactgataacgatgtgaagaatttctggagtagcagacaaaagagactcgctaggattcttcataactcctctgatgcatcgagttcgagtttcaatcccaaatcttcttcttctcatcgactcaagggcaaaaacgtcaaaccaatccgtcaatcctctcagggttttggtttggttgaggaagaggttacagtttcttcttcatgttcccagatggttccttattcatctgatcaagttggtgatgaagtcttgaggttgccggatttgggtgttaagttagagcatcagcctttcgcttttggcactgatcttgtcctagcagagtactctgactcacagaatgatgcaaatcagcaagcaatcagccctttctctccagaaagcagagagcttttggctagacttgacgaccctttttactatgatatacttggaccagctgattcttctgagccattgttcgctctccctcagccgttcttcgagccttcgcctgtgccgagaagatgcagacatgtttcaaaggatgaagaagctgatgttttcttagacgatttcccagctgacatgtttgatcaggttgatccaatcccaagtccttag

SEQ ID NO: 494 - protein, 297 aa, Arabidopsis thaliana
MEAKKEEIKKGPWKAEEDEVLINHVKRYGPRDWSSIRSKGLLQRTGKSCRLRWVNKLRPNLKNGCKFSADEERTVIELQSEFGNKWARIATYLPGRTDNDVKNFWSSRQKRLARILHNSSDASSSSFNPKSSSSHRLKGKNVKPIRQSSQGFGLVEEEVTVSSSCSQMVPYSSDQVGDEVLRLPDLGVKLEHQPFAFGTDLVLAEYSDSQNDANQQAISPFSPESRELLARLDDPFYYDILGPADSSEPLFALPQPFFEPSPVPRRCRHVSKDEEADVFLDDFPADMFDQVDPIPSP

SEQ ID NO: 495 - DNA, 1878 bp, Arabidopsis thaliana
tctcagagcaaaaaacaaaaaaaaagaaaaaaaaaccctaaatctaaatctcaccttccacctctgtcttttttttttttgttcttttttttttttttactgtatcttctcttctctttgctctgcaaaaatctcacatccatggatccatctcttggtgatcctcatcatcctcctcagttcaccccttttcctcattttcccacctccaatcatcatcctttaggaccaaatccgtacaataaccatgtcgtcttccaaccgcagccgcaaacgcaaacgcaaatcccgcaaccgcagatgtttcagttatctccacatgtttcaatgccccaccctccttactccgaaatgatttgcgctgcgattgcggcgttaaacgaaccggatggttcgagcaagatggcaatttcgagatacatcgagagatgttacaccggtttaacttctgctcatgctgctttgttgactcaccatctcaagactttgaagaccagtggtgttctttctatggttaagaaatcttacaaaattgctggttcttctactcctcctgctagtgtagctgttgctgctgctgccgccgctcaaggtctcgatgttcccagatctgagattctccattcaagtaacaacgatcccatggcttctggctctgcttctcagcctctgaaacgaggtcgtggtcgtcctcctaagcctaaacctgaatctcaaccacaaccactacagcaacttccaccgaccaatcaagtccaggctaacggacagccaatctgggaacagcagcaagttcaatcacctgttccggttccgactccggttacagagtcggcgaagagaggacctggtcgtccaaggaagaacggttctgctgctcctgctactgcaccaatcgttcaagcttcggttatggctggaattatgaaacgtagaggtagaccaccgggtcgtcgagctgctgggagacagaggaagcccaaatccgtttcttctactgcctctgtgtatccttatgttgctaatggtgctagacgcagaggaaggcctaggagagttgttgaccctagcagtattgttagtgttgctccagtaggtggtgaaaatgtggcagcggttgcgccagggatgaagcgtggacgtggacgaccacctaagattggtggtgttatcagtaggcttattatgaagcctaagagaggacgaggacgtcctgtaggtagacccagaaagattggaacatcagtcacgactgggacacaagattctggagaactcaagaagaagtttgatatttttcaagagaaagtgaaagaaattgtgaaggtgttgaaggatggagttacaagtgagaatcaagcagtggtgcaagccataaaagatctggaagcactaacagtgacggagaccgttgagccacaagttatggaagaagtgcagccagaggagactgcagcaccacagactgaagctcaacaaactgaagctgctgagacacaaggaggacaagaagaaggacaagaaagagaaggagaaacacagacccagacagaagcagaggcaatgcaagaagctctgttctgaagaataataatgatctagaaaacaacctagacataatagccttggtgtttggcgttaggagtgtttttttttagttgttttaggtgttggaatcgcatcttaaattatataaaaatctataaggaattttaatttttctaggttttgttgtctgcagaagaagaaatagtagactcgttaatggtgttgttgtcggtgtgtctttaaccaaaccataagacgtggctgtaaattagcgatgtttctagtcttccatctttaataatctcttattgcgtctgtgcctttgttttt

SEQ ID NO: 496 - protein, 480 aa, Arabidopsis thaliana
MDPSLGDPHHPPQFTPFPHFPTSNHHPLGPNPYNNHVVFQPQPQTQTQIPQPQMFQLSPHVSMPHPPYSEMICAAIAALNEPDGSSKMAISRYIERCYTGLTSAHAALLTHHLKTLKTSGVLSMVKKSYKIAGSSTPPASVAVAAAAAAQGLDVPRSEILHSSNNDPMASGSASQPLKRGRGRPPKPKPESQPQPLQQLPPTNQVQANGQPIWEQQQVQSPVPVPTPVTESAKRGPGRPRKNGSAAPATAPIVQASVMAGIMKRRGRPPGRRAAGRQRKPKSVSSTASVYPYVANGARRRGRPRRVVDPSSIVSVAPVGGENVAAVAPGMKRGRGRPPKIGGVISRLIMKPKRGRGRPVGRPRKIGTSVTTGTQDSGELKKKFDIFQEKVKEIVKVLKDGVTSENQAVVQAIKDLEALTVTETVEPQVMEEVQPEETAAPQTEAQQTEAAETQGGQEEGQEREGETQTQTEAEAMQEALF

SEQ ID NO: 497 - DNA, 1040 bp, Arabidopsis thaliana
ctttagggacaccaaatctattcaacctaaaagccttcttttcccctatattgaccaactttttagcgaatcagaagaggaatggatgaggtatctcgttctcatacaccgcaatttctatcaagtgatcatcagcactatcaccatcaaaacgctggacgacaaaaacgcggcagagaagaagaaggagttgaacccaacaatataggggaagacctagccacctttccttccggagaagagaatatcaagaagagaaggccacgtggcagacctgctggttccaagaacaaacccaaagcaccaatcatagtcactcgcgactccgcgaacgccttcagatgtcacgtcatggagataaccaacgcctgcgatgtaatggaaagcctagccgtcttcgctagacgccgtcagcgtggcgtttgcgtcttgaccggaaacggggccgttacaaacgtcaccgttagacaacctggcggaggcgtcgtcagtttacacggacggtttgagattctttctctctcgggttcgtttcttcctccaccggcaccaccagctgcgtctggtttaaaggtttacttagccggtggtcaaggtcaagtgatcggaggcagtgtggtgggaccgcttacggcatcaagtccggtggtcgttatggcagcttcatttggaaacgcatcttacgagaggctgccactagaggaggaggaggaaactgaaagagaaatagatggaaacgcggctagggcgattggaacgcaaacgcagaaacagttaatgcaagatgcgacatcgtttattgggtcgccgtcgaatttaattaactctgtttcgttgccaggtgaagcttattggggaacgcaacgaccgtctttctaagataatatcattgataatataagtttcgtcttcttattctttttcactttttacctttttcactttcttaggttttgttttaacgtttgattaatacctgaaggtttttggaaaattttcgatcggataaaaggatttatgttgcgagccgaaacgcggcc

SEQ ID NO: 498 - protein, 265 aa, Arabidopsis thaliana
MDEVSRSHTPQFLSSDHQHYHHQNAGRQKRGREEEGVEPNNIGEDLATFPSGEENIKKRRPRGRPAGSKNKPKAPIIVTRDSANAFRCHVMEITNACDVMESLAVFARRRQRGVCVLTGNGAVTNVTVRQPGGGVVSLHGRFEILSLSGSFLPPPAPPAASGLKVYLAGGQGQVIGGSVVGPLTASSPVVVMAASFGNASYERLPLEEEEETEREIDGNAARAIGTQTQKQLMQDATSFIGSPSNLINSVSLPGEAYWGTQRPSF

SEQ ID NO: 499 - DNA, 679 bp, Arabidopsis thaliana
cttttataagcaatggctccaagacaggcgaacggtagaagcattgccgtgagtgaaggcggcggagggaagacgatgacgatgacgacgatgcggaaggaagtgcactttagaggtgtgaggaagcgtccatggggtagatacgcggcggagatccgtgacccgggaaagaaaacccgggtttggctcgggacattcgacacggcggaggaagctgcaagagcttacgacaccgccgctagagagtttcgtggctccaaagcaaagactaatttccctcttcccggagagtctactacggttaacgacggtggcgagaacgattcttacgtcaaccgtacgacggtgacgacggcgcgtgagatgacgcgtcagagatttccgtttgcatgtcaccgggagcgtaaagtcgtcggtggttatgcttctgctggttttttcttcgatccgtcaagagctgcttcgttaagagcagagctttctcgggtttgtccggttcggtttgatccggttaatatcgagttgagtattggtattcgagaaaccgtaaaagttgaaccgagaagagaactaaacctggatcttaacctagctccaccggtggtggacgtttagatttttttcttcttttcataatttgtattttacattgccggaaaataattaatgttttctttag

SEQ ID NO: 500 - protein, 200 aa, Arabidopsis thaliana
MAPRQANGRSIAVSEGGGGKTMTMTTMRKEVHFRGVRKRPWGRYAAEIRDPGKKTRVWLGTFDTAEEAARAYDTAAREFRGSKAKTNFPLPGESTTVNDGGENDSYVNRTTVTTAREMTRQRFPFACHRERKVVGGYASAGFFFDPSRAASLRAELSRVCPVRFDPVNIELSIGIRETVKVEPRRELNLDLNLAPPVVDV

SEQ ID NO: 501 - DNA, 933 bp, Arabidopsis thaliana
attctcccccaaccaaaatatgaccacagaaaaagagaatgtcactacggccgtggccgtgaaagacggcggagaaaagagtaaggaagtgagtgacaagggcgtaaagaagagaaagaatgtaactaaggccctggccgtgaatgacggcggagaaaagagtaaggaagtgcgttacaggggtgtaaggaggagaccatgggggagatatgctgcggagatccgtgatccggtaaagaaaaaacgggtctggctcgggtccttcaacacgggggaggaagccgccagagcctacgactccgctgccataaggtttcgaggatcgaaagctactactaacttccctctaatcggatactatgggatttcttcggcgacgccggtgaacaacaacctttccgagacggtgagtgatggaaatgccaacctccctctcgttggagacgatgggaatgctttggcttctccggtgaacaacaccctttccgaaacggcgcgtgatggaacacttccatcggattgtcacgacatgttatctccgggggtggctgaagcggttgctggatttttcttagatctgcctgaagttattgcgttgaaagaggagcttgatcgagtttgtcctgaccagtttgagtccattgatatggggttgactattggtcctcaaaccgccgtggaagagcctgagacttcctccgccgtggattgtaagctgcgaatggaaccggatcttgacctcaacgcaagtccctaaagattgatctgatgttgttgtccttgaataagtttgttatcttgtcgctcttctgattgtctgtacttctattggttgattcgtgcttttggaggacaaaacaaacatttttttatgtattaaaaaaaggtaattgaactattatcgaaaaaaaaaaaaaaaaaaaaaaaaaaaaa

SEQ ID NO: 502 - protein, 245 aa, Arabidopsis thaliana
MTTEKENVTTAVAVKDGGEKSKEVSDKGVKKRKNVTKALAVNDGGEKSKEVRYRGVRRRPWGRYAAEIRDPVKKKRVWLGSFNTGEEAARAYDSAAIRFRGSKATTNFPLIGYYGISSATPVNNNLSETVSDGNANLPLVGDDGNALASPVNNTLSETARDGTLPSDCHDMLSPGVAEAVAGFFLDLPEVIALKEELDRVCPDQFESIDMGLTIGPQTAVEEPETSSAVDCKLRMEPDLDLNASP

SEQ ID NO: 503 - DNA, 723 bp, Arabidopsis thaliana
atggacgtctacggcatgtcttcaccggacttgcttcgtatcgacgaccttctcgatttctccaacgacgaaatcttctcttcctcttccaccgtcacttcctccgccgcttcctccgccgcttcttccgaaaaccctttcagctttccttcttccacctacacttctcctactctcctcaccgacttcactcacgatctctgcgttcccagtgacgacgcagctcatctcgaatggttatcgcgattcgttgacgattcattctccgatttcccagcaaatcctttaaccatgaccgttagacccgagatttcattcaccggaaaacctagaagtcgccgatcaagagcaccagcaccttccgtagctggaacttgggctccgatgtctgaatcagagctttgtcactccgtcgctaaacctaaaccgaagaaagtctacaacgctgaatcggttacggcggatggagcgaggcggtgcacgcactgtgcctcggagaaaacgccacagtggagaactggaccgcttggacctaaaacactttgtaacgcttgtggagttcgttacaaatcagggaggcttgtaccggaatacagaccggcgtcgagtccgacgtttgtattgactcagcattcgaactctcatcggaaagttatggagctccggcgacagaaggaacaacaagaatcttgcgttcgaattccgccgtttcagccgcagtaa

SEQ ID NO: 504 - protein, 240 aa, Arabidopsis thaliana
MDVYGMSSPDLLRIDDLLDFSNDEIFSSSSTVTSSAASSAASSENPFSFPSSTYTSPTLLTDFTHDLCVPSDDAAHLEWLSRFVDDSFSDFPANPLTMTVRPEISFTGKPRSRRSRAPAPSVAGTWAPMSESELCHSVAKPKPKKVYNAESVTADGARRCTHCASEKTPQWRTGPLGPKTLCNACGVRYKSGRLVPEYRPASSPTFVLTQHSNSHRKVMELRRQKEQQESCVRIPPFQPQ

SEQ ID NO: 505 - DNA, 817 bp, Arabidopsis thaliana
aatacaccacacacttcactctttcttcatcttcttcttcttaaatagctcgaaatcacatctcacagaattaaatcttatggctctcgagactctcaattctccaacagctaccaccaccgctcggcctcttctccggtatcgtgaagaaatggagcctgagaatctcgagcaatgggctaaaagaaaacgaacaaaacgtcaacgttttgatcacggtcatcagaatcaagaaacgaacaagaaccttccttctgaagaagagtatctcgctctttgtctcctcatgctcgctcgtggctccgccgtacaatctcctcctcttcctcctctaccgtcacgtgcgtcaccgtccgatcaccgagattacaagtgtacggtctgtgggaagtccttttcgtcataccaagccttaggtggacacaagacgagtcaccggaaaccgacgaacactagtatcacttccggtaaccaagaactgtctaataacagtcacagtaacagcggttccgttgttattaacgttaccgtgaacactggtaacggtgttagtcaaagcggaaagattcacacttgctcaatctgtttcaagtcgtttgcgtctggtcaagccttaggtggacacaaacggtgtcactatgacggtggcaacaacggtaacggtaacggaagtagcagcaacagcgtagaactcgtcgctggtagtgacgtcagcgatgttgataatgagagatggtccgaagaaagtgcgatcggtggccaccgtggatttgacctaaacttaccggctgatcaagtctcagtgacgacttcttaa

SEQ ID NO: 506 - protein, 245 aa, Arabidopsis thaliana
MALETLNSPTATTTARPLLRYREEMEPENLEQWAKRKRTKRQRFDHGHQNQETNKNLPSEEEYLALCLLMLARGSAVQSPPLPPLPSRASPSDHRDYKCTVCGKSFSSYQALGGHKTSHRKPTNTSITSGNQELSNNSHSNSGSVVINVTVNTGNGVSQSGKIHTCSICFKSFASGQALGGHKRCHYDGGNNGNGNGSSSNSVELVAGSDVSDVDNERWSEESAIGGHRGFDLNLPADQVSVTTS

SEQ ID NO: 507 - DNA, 615 bp, Arabidopsis thaliana
atgcagaacaaacacaaatgcaagctctgttccaagagtttctgtaatggcagagcacttggtggtcacatgaagtctcacttggtctcatctcagtcttcagctcggaagaaactaggtgactcggtctattcttcttcttcctcttcctccgatggtaaagcgctcgcctacgggttacgagagaacccgaggaagagtttccgggtctttaatccggatcctgagtcatccacaatttacaacagtgagacagagaccgaacctgaatccggagacccggttaagaaacgggtcagaggagatgtttcaaagaagaagaagaagaaggcaaagagtaagagagtgtttgagaactcgaagaagcaaaagacaattcacgagtcaccagaaccagcgagttctgtctctgatggttctcctgaacaagatttagctatgtgcttgatgatgctgtcaagagattcaagggagctcgagattaaactgaaaaaaccggaggaagagaggaagccggaaaaaagacatttccctgagctccgtcgctgtatgatagatctgaatcttcctccgccgcaagaagctgaagctgtcaccgtcgtttcagccatataa

SEQ ID NO: 508 - protein, 204 aa, Arabidopsis thaliana
MQNKHKCKLCSKSFCNGRALGGHMKSHLVSSQSSARKKLGDSVYSSSSSSSDGKALAYGLRENPRKSFRVFNPDPESSTIYNSETETEPESGDPVKKRVRGDVSKKKKKKAKSKRVFENSKKQKTIHESPEPASSVSDGSPEQDLAMCLMMLSRDSRELEIKLKKPEEERKPEKRHFPELRRCMIDLNLPPPQEAEAVTVVSAI

SEQ ID NO: 509 - DNA, 855 bp, Arabidopsis thaliana
atgggtcaagatgaggttgggagtgatcagacgcaaatcataaaagggaaacgtacgaagcgacaaagatcgtcttcgacgtttgtggtgacggcggcgacaacagtgacttcaacaagttcatcggccggtggaagtggaggagaaagagctgtttcagatgaatacaactcggcggtttcgtctccggtgactactgattgtacgcaagaagaagaagacatggcgatttgtctcatcatgttagctcgtgggacagttcttccatcgccggatctcaagaactcgagaaaaattcatcagaagatttcgtcggagaattctagtttctatgtgtacgagtgtaaaacgtgtaaccggacgttttcgtcgttccaagcacttggtggacacagagcgagccacaagaagccgaggacgtcgactgaggaaaagactagactacccctgacgcaacccaagtctagtgcatcagaagaagggcaaaacagtcatttcaaagtttccggctcagccctagcttcacaggcaagtaacatcatcaacaaggcaaacaaagtacacgagtgttccatctgcggttctgagttcacttccgggcaagctctcggtggtcacatgaggcggcacaggacagccgtaaccacgattagccccgttgcagccaccgcagaagtaagcagaaacagtacagaggaagagattgagatcaatataggccgttcgatggaacagcagaggaaatatctaccgttggatcttaatctaccagcaccagaagatgatctaagagagtcaaagtttcaagggatagtattctcagcaacaccagcgttaatagattgtcattactag

SEQ ID NO: 510 - protein, 284 aa, Arabidopsis thaliana
MGQDEVGSDQTQIIKGKRTKRQRSSSTFVVTAATTVTSTSSSAGGSGGERAVSDEYNSAVSSPVTTDCTQEEEDMAICLIMLARGTVLPSPDLKNSRKIHQKISSENSSFYVYECKTCNRTFSSFQALGGHRASHKKPRTSTEEKTRLPLTQPKSSASEEGQNSHFKVSGSALASQASNIINKANKVHECSICGSEFTSGQALGGHMRRHRTAVTTISPVAATAEVSRNSTEEEIEINIGRSMEQQRKYLPLDLNLPAPEDDLRESKFQGIVFSATPALIDCHY

SEQ ID NO: 511 - DNA, 543 bp, Arabidopsis thaliana
atgtggaaccctaacaaaattgaagaattggaggatgatgatgaatcttgggaagtcaaagcctttgagcaagacactaaaggcaacatctctggtaccacttggcctccaagatcttacacttgcaatttctgccgccgtgagttccgttctgctcaagccttaggcggtcacatgaatgtccaccgccgtgaccgcgcctcatctagggctcatcaaggttccaccgttgcggctgcggctagaagcggccacggggggatgttactcaattcttgtgctccgccgttgcctacaacgacacttataatacaatccacggcgagtaacattgaaggtttgtcccatttctaccaactgcaaaaccctagtggcatttttggtaattctggtgacatggtgaatctttatgtagaagttcctcctcggcttattgaatattcgacaggagatgatgagagcattggctcgatgaaagaagcgacaggaacatcagtggatgagcttgatcttgaacttcggctagggcaccatccaccgtga

SEQ ID NO: 512 - protein, 180 aa, Arabidopsis thaliana
MWNPNKIEELEDDDESWEVKAFEQDTKGNISGTTWPPRSYTCNFCRREFRSAQALGGHMNVHRRDRASSRAHQGSTVAAAARSGHGGMLLNSCAPPLPTTTLIIQSTASNIEGLSHFYQLQNPSGIFGNSGDMVNLYVEVPPRLIEYSTGDDESIGSMKEATGTSVDELDLELRLGHHPP

SEQ ID NO: 513 - DNA, 977 bp, Arabidopsis thaliana
ataaaaaacccttcatacaatataaaatttctttagacatacaatatattatactattacagatgcaatgcatcattagttacaaactattaaactaaatatcccccgtctctctcttgctatataaagaagatcatttacacatctccttaagcaaattaaacccatcgataaacacatacgttcacacatatatgtctataaatccgacaatgtctcgtactggcgaaagttcttcaggttcgtcctccgacaagacgataaagctattcggcttcgaactcatcagcggcagtcgtacgccggaaatcacgacggcggaaagcgtgagctcgtccacaaacacgacgtcgttaacagtgatgaaaagacacgagtgccaatactgcggtaaagagtttgcaaattctcaagccttaggaggtcaccaaaacgctcacaagaaggagaggttgaagaagaagaggcttcagcttcaagctcggcgagccagcatcggctattatctcaccaaccaccaacaacccataacgacgtcatttcagagacaatacaaaacgccgtcgtattgtgcattctcctccatgcacgtgaataatgatcagatgggtgtgtacaacgaagattggtcgtcgaggtcgtcgcagattaacttcggtaataatgacacgtgccaagatcttaatgaacaaagcggtgagatgggtaagctgtacggtgttcgaccgaacatgattcagttccagagagatctgagttctcgttctgatcagatgagaagtattaactcgctggatcttcatctaggttttgccggagatgcggcataacaaattaaagagagatatatgattaagattatatgtactatagtggcgtatttcattgggatcatgaaggggaaaaaacgagacatatagtattcttgatgcaatttgagttttgtaatttatttaggtttatgtatgttttcgaag

SEQ ID NO: 514 - protein, 211 aa, Arabidopsis thaliana
MSINPTMSRTGESSSGSSSDKTIKLFGFELISGSRTPEITTAESVSSSTNTTSLTVMKRHECQYCGKEFANSQALGGHQNAHKKERLKKKRLQLQARRASIGYYLTNHQQPITTSFQRQYKTPSYCAFSSMHVNNDQMGVYNEDWSSRSSQINFGNNDTCQDLNEQSGEMGKLYGVRPNMIQFQRDLSSRSDQMRSINSLDLHLGFAGDAA

SEQ ID NO: 515 - DNA, 728 bp, Arabidopsis thaliana
aagcttgatatcgcctctctctaatctctctttctctctctatctctaagaatatataaaggtatggactaccagccaaacacatccctacgtctaagcctaccaagttacaagaaccaccaactaaacctagaacttgttctcgagccttcttccatgtcttcttcttcatcttcttccacgaactcatcatcatgtttggagcagcctagggtattctcatgtaactattgtcaaagaaagttttacagctctcaagctcttggtggtcatcaaaacgctcataagcttgagagaaccttagccaagaagagtcgagaactctttagatcctcaaacactgttgattctgatcagccttacccgttctccggtcgctttgagctttacggccgtggctaccaaggatttctcgaaagtggcggctcgagggacttctccgcccgccgtgtgccggagagtggtcttgatcaggatcaggagaagagtcaccttgacttatccttaaggctctaaaagaatcttatattttgttagtctatatattatcatatcaattgttaatcttaaaattgattgttttacttattagtcatttcctattatctgaaagttttctttgtaagttgtaactatggtcctaaattcaaatccaaatttgattttggaagatggtacctaatgcagtagttaaataagttaaaaaaatgaaggatctataattctct

SEQ ID NO: 516 - protein, 150 aa, Arabidopsis thaliana
MDYQPNTSLRLSLPSYKNHQLNLELVLEPSSMSSSSSSSTNSSSCLEQPRVFSCNYCQRKFYSSQALGGHQNAHKLERTLAKKSRELFRSSNTVDSDQPYPFSGRFELYGRGYQGFLESGGSRDFSARRVPESGLDQDQEKSHLDLSLRL

SEQ ID NO: 517 - DNA, 925 bp, Arabidopsis thaliana
caattcttttactttcattctctttatatattctctctacgctataatatatattacacagaatatacatggaaccgtccatcaaaggagatcaagaaatgttaaaaatcaagaaacaaggtcatcaagatcttgagttggggttgacccttttgtcacgtggaaccgcgacctcatcagagctcaatctcatcgattctttcaaaaccagctcatcatcgacttctcatcatcagcaccagcaagaacaattggcagatccgagagtgttctcgtgtaattattgtcaaagaaagttctatagttcacaagcgctaggcggtcaccaaaacgctcataaacgtgagcgcaccttagccaaacgtggacagtattacaagatgactctctcctccttgccttcttcagcgtttgcgtttggccacggttcagtcagcagattcgcaagcatggcatcgttaccattacatggctcggtgaataacaggtcaacgttagggattcaagctcattcaacgatccataagcccagcttcttaggaagacaaacgacgagtttaagtcatgttttcaaacagagcattcaccagaaaccgaccataggaaagatgttgccggagaaatttcaccttgaagtcgccggaaataataacagtaacatggttgctgctaagttggagagaattggacatttcaagagcaaccaagaagatcataatcagtttaagaaaattgacttgactcttaagctatgagctctgccatcttctttttagtcttcattataactttttttattctcatctttgtttgatataatgattgacggcagggtgtgttagagtttcactaatgatcaagttgtactttttatatatttcattgataccttgttgatgtaattcaatattttaggtctgttttt

SEQ ID NO: 518 - protein, 228 aa, Arabidopsis thaliana
MEPSIKGDQEMLKIKKQGHQDLELGLTLLSRGTATSSELNLIDSFKTSSSSTSHHQHQQEQLADPRVFSCNYCQRKFYSSQALGGHQNAHKRERTLAKRGQYYKMTLSSLPSSAFAFGHGSVSRFASMASLPLHGSVNNRSTLGIQAHSTIHKPSFLGRQTTSLSHVFKQSIHQKPTIGKMLPEKFHLEVAGNNNSNMVAAKLERIGHFKSNQEDHNQFKKIDLTLKL

SEQ ID NO: 519 - DNA, 708 bp, Arabidopsis thaliana
atggacgcttcaatagtttcctcatccactgcttttccatatcaagattctctaaaccagagcatcgaagacgaagaaagagacgttcataattctagtcacgaactcaatctcatcgactgcatagacgacacaacgagtatcgttaacgaatctacaacatccacagaacaaaagcttttctcatgcaactattgtcaaagaactttctatagctcacaagcacttggtggtcaccaaaacgcacacaagagagagagaacgttggcgaagagaggacaacgtatggcagcgtcagcctcagcttttggacatccttacggtttctctccacttcctttccacggacagtacaacaaccataggtctttagggatccaagcgcattcgataagccacaagctaagttcttataacgggtttggtggtcactatggtcagatcaactggtcaagacttccatttgatcaacaaccagccataggtaaatttccctcaatggataattttcatcatcatcatcatcagatgatgatgatggctccttcagtaaattcacggtccaataacatcgatagcccaagcaacacaggacgggttctagaagggtcaccgactcttgaacaatggcacggagacaaaggattgttgttaagtacaagtcatcatgaagagcagcagaaacttgacttgtccctcaagctttga

SEQ ID NO: 520 - protein, 235 aa, Arabidopsis thaliana
MDASIVSSSTAFPYQDSLNQSIEDEERDVHNSSHELNLIDCIDDTTSIVNESTTSTEQKLFSCNYCQRTFYSSQALGGHQNAHKRERTLAKRGQRMAASASAFGHPYGFSPLPFHGQYNNHRSLGIQAHSISHKLSSYNGFGGHYGQINWSRLPFDQQPAIGKFPSMDNFHHHHHQMMMMAPSVNSRSNNIDSPSNTGRVLEGSPTLEQWHGDKGLLLSTSHHEEQQKLDLSLKL

SEQ ID NO: 521 - DNA, 1854 bp, Arabidopsis thaliana
atggcgattgaaactcagcttccttgcgacggtgacggtgtgtgtatgcggtgtcaggtgaatcctccgtcagaagagactctcacttgtggcacgtgcgtcactccatggcacgtgccgtgtctcctccccgaatcactcgcttcttccactggagagtgggagtgtcccgattgctccggcgttgtcgttccctccgccgctccgggtaccggaaacgctcgacctgaatcttccggttcagttctcgttgctgcgatccgtgcgattcaggctgatgagactttaaccgaagctgagaaagccaaaaaaaggcagaaactgatgagtgggggtggtgacgatggtgtcgatgaagaagagaagaagaagttagaaatcttttgttctatttgcattcaattgccagaaagacctatcacgacaccgtgtgggcacaatttctgtttgaaatgtttcgagaaatgggcagtaggtcaagggaagctaacttgtatgatatgccgaagcaaaattccgagacatgtggcaaaaaatcctcgcatcaacttagctctagtttctgctattcgtttagcaaatgttaccaaatgttctgttgaggcaactgcagccaaggttcatcatattatccgcaaccaagaccgtcctgagaaagcatttactaccgagcgggcagtaaaaactgggaaagctaatgctgctagcggtaagttttttgtgacaatacctcgtgatcattttggtcccataccagctgagaatgatgtcactagaaagcaaggtgttttggttggagaatcttgggaggacaggcaagagtgtaggcagtggggagctcatttcccgcatattgctggcattgccgggcaatcagcggttggagctcagtctgtggccctctctggaggttatgacgatgatgaggatcatggtgaatggtttctctacacaggaagtggtggaagggatctcagtggaaacaaaagaattaacaagaaacagtcgtctgaccaggcgtttaaaaacatgaatgaatctctaagacttagttgcaaaatgggctatcctgtccgagttgtcaggtcttggaaggagaagcgttctgcatatgcccctgctgaaggtgtgagatatgatggggtctatcgaattgagaagtgctggagtaatgttggagtacagggttcttttaaggtctgtcgttacctgtttgttagatgtgacaatgagccagctccatggaccagtgatgagcatggcgatcgtccaagaccgttgcctaatgttccggagcttgagactgctgctgacctgtttgtgagaaaggagagtccatcatgggatttcgatgaagctgagggtcgttggaaatggatgaagtctcctcctgttagcagaatggctttggatcctgaggagaggaagaagaataagagagcaaaaaatactatgaaggccagacttctgaaagaatttagttgccaaatctgtcgggaagtgctgagtcttccagtgacgacgccttgtgcacacaacttctgcaaagcatgcttagaagcgaagtttgctgggataactcaactgagagagagaagcaatggcggacgtaaactacgtgcaaagaagaacatcatgacctgcccttgctgcacgacggatctctccgagtttctccaaaacccgcaggtgaacagagagatgatggagataatagagaattttaagaagagtgaggaagaggctgatgcatccatttctgaagaagaagaagaagaatccgaacctccaactaagaagattaagatggataacaactctgttggtggtagtggtacaagtctctcagcttaa

SEQ ID NO: 522 - protein, 617 aa, Arabidopsis thaliana
MAIETQLPCDGDGVCMRCQVNPPSEETLTCGTCVTPWHVPCLLPESLASSTGEWECPDCSGVVVPSAAPGTGNARPESSGSVLVAAIRAIQADETLTEAEKAKKRQKLMSGGGDDGVDEEEKKKLEIFCSICIQLPERPITTPCGHNFCLKCFEKWAVGQGKLTCMICRSKIPRHVAKNPRINLALVSAIRLANVTKCSVEATAAKVHHIIRNQDRPEKAFTTERAVKTGKANAASGKFFVTIPRDHFGPIPAENDVTRKQGVLVGESWEDRQECRQWGAHFPHIAGIAGQSAVGAQSVALSGGYDDDEDHGEWFLYTGSGGRDLSGNKRINKKQSSDQAFKNMNESLRLSCKMGYPVRVVRSWKEKRSAYAPAEGVRYDGVYRIEKCWSNVGVQGSFKVCRYLFVRCDNEPAPWTSDEHGDRPRPLPNVPELETAADLFVRKESPSWDFDEAEGRWKWMKSPPVSRMALDPEERKKNKRAKNTMKARLLKEFSCQICREVLSLPVTTPCAHNFCKACLEAKFAGITQLRERSNGGRKLRAKKNIMTCPCCTTDLSEFLQNPQVNREMMEIIENFKKSEEEADASISEEEEEESEPPTKKIKMDNNSVGGSGTSLSA

SEQ ID NO: 523 - DNA, 957 bp, Arabidopsis thaliana
atgggggaaagagatgatgggttgggtttgagtctaagcttgggaaatagtcaacaaaaagaaccatctctgaggttgaatcttatgccgttgacaacttcttcttcttcttcttcgtttcaacacatgcacaatcagaataacaatagccatccccagaagattcataacatctcttggactcatctgtttcaatcttctgggattaaacgtacaactgcagagagaaactccgacgccgggtcatttctaagaggtttcaacgtgaacagagctcagtcttcggtggcggtagtggacttggaagaagaagccgccgtcgtctcgtctccaaacagcgccgtttcgagtctgagtggaaataaaagggatcttgcggtggcgagaggaggagatgaaaacgaggcggagagagcttcttgctcacgcggagggggaagcggtggtagcgacgatgaagacggcggaaacggcgacggatcaaggaagaaactacggttatcgaaggatcaagctcttgttctcgaggagacttttaaagaacatagcactcttaatccgaagcaaaagctggctctagcaaaacagttgaatctaagggcaagacaagttgaagtgtggtttcagaaccgtagggcaaggacgaagctgaaacaaacggaggttgattgtgagtatttaaagagatgttgcgataatctgaccgaggagaatcgacggctgcagaaagaagtgtcggagctgagggcgttgaagttgtctccacatctctacatgcacatgactcctcctactactctcaccatgtgcccttcttgcgaacgtgtctcctcctctgccgccactgtgaccgctgctccttccactactactactcctacggtggtggggcggccaagtccacagcgattaactccttggactgctatttctctccagcaaaaatcaggtcgctag

SEQ ID NO: 524 - protein, 318 aa, Arabidopsis thaliana
MGERDDGLGLSLSLGNSQQKEPSLRLNLMPLTTSSSSSSFQHMHNQNNNSHPQKIHNISWTHLFQSSGIKRTTAERNSDAGSFLRGFNVNRAQSSVAVVDLEEEAAVVSSPNSAVSSLSGNKRDLAVARGGDENEAERASCSRGGGSGGSDDEDGGNGDGSRKKLRLSKDQALVLEETFKEHSTLNPKQKLALAKQLNLRARQVEVWFQNRRARTKLKQTEVDCEYLKRCCDNLTEENRRLQKEVSELRALKLSPHLYMHMTPPTTLTMCPSCERVSSSAATVTAAPSTTTTPTVVGRPSPQRLTPWTAISLQQKSGR

SEQ ID NO: 525 - DNA, 1149 bp, Arabidopsis thaliana
atggagagtggttccaacagcacttcttgtccaatggcttttgccggggataatagtgatggtccgatgtgtcctatgatgatgatgatgccgcccatcatgacatcacatcaacatcatggtcatgatcatcaacatcaacaacaagaacatgatggttatgcatatcagtcacaccaccaacaaagtagttccctttttcttcaatcactagctcctccccaaggaactaagaacaaagttgcttcttcttcttctccttcctcttgtgctcctgcctattctctaatggagatccatcataacgaaatcgttgcaggaggaatcaacccttgctcctctttctcttcttcagcctctgtcaaggccaagatcatggctcatcctcactaccaccgcctcttggccgcttatgtcaattgtcagaaggttggagcaccaccggaggttgtggcgaggctggaggaggcatgctcgtctgccgcagccgcagccgcatctatggggccaacagggtgtcttggtgaagatccagggcttgatcaattcatggaagcttactgtgaaatgctcgttaagtatgagcaagagctctccaaacctttcaaggaagctatggtcttccttcaacgtgtcgagtgtcaattcaaatccctctctctatcctcaccttcctctttctccggttatggagagacagcaattgataggaacaataatgggtcatccgaggaagaagtcgatatgaacaatgaatttgtagatccacaagctgaggatagagagcttaaaggacagctcttgcgcaagtacagtggttacttagggagcctcaagcaagagttcatgaagaagaggaagaaaggaaagctccctaaagaagctcgtcaacaactgcttgattggtggagccgtcactacaaatggccttacccttcggagcaacaaaagctcgcccttgcggaatcaacggggctggaccagaaacagataaacaattggttcataaaccagaggaaacggcattggaagccgtcggaggacatgcagtttgtagtaatggacgcaacacatcctcaccattacttcatggataatgtcttggacaatcctttcccaatggatcacatctcctccaccatgctttga

SEQ ID NO: 526 - protein, 382 aa, Arabidopsis thaliana
MESGSNSTSCPMAFAGDNSDGPMCPMMMMMPPIMTSHQHHGHDHQHQQQEHDGYAYQSHHQQSSSLFLQSLAPPQGTKNKVASSSSPSSCAPAYSLMEIHHNEIVAGGINPCSSFSSSASVKAKIMAHPHYHRLLAAYVNCQKVGAPPEVVARLEEACSSAAAAAASMGPTGCLGEDPGLDQFMEAYCEMLVKYEQELSKPFKEAMVFLQRVECQFKSLSLSSPSSFSGYGETAIDRNNNGSSEEEVDMNNEFVDPQAEDRELKGQLLRKYSGYLGSLKQEFMKKRKKGKLPKEARQQLLDWWSRHYKWPYPSEQQKLALAESTGLDQKQINNWFINQRKRHWKPSEDMQFVVMDATHPHHYFMDNVLDNPFPMDHISSTML

SEQ ID NO: 527 - DNA, 1128 bp, Arabidopsis thaliana
atggagatgggttccaactcgggtccgggtcatggtccgggtcaggcagagtcgggtggttcctccactgagtcatcctctttcagtggagggctcatgtttggccagaagatctacttcgaggacggtggtggtggatccgggtcttcttcctcaggtggtcgttcaaacagacgtgtccgtggaggcgggtcgggtcagtcgggtcagataccaaggtgccaagtggaaggttgtgggatggatctaaccaatgcaaaaggttattactcgagacaccgagtttgtggagtgcactctaaaacacctaaagtcactgtggctggtatcgaacagaggttttgtcaacagtgcagcaggtttcatcagcttccggaatttgacctagagaaaaggagttgccgcaggagactcgctggtcataatgagcgacgaaggaagccacagcctgcgtctctctctgtgttagcttctcgttacgggaggatcgcaccttcgctttacgaaaatggtgatgctggaatgaatggaagctttcttgggaaccaagagataggatggccaagttcaagaacattggatacaagagtgatgaggcggccagtgtcgtcaccgtcatggcagatcaatccaatgaatgtatttagtcaaggttcagttggtggaggagggacaagcttctcatctccagagattatggacactaaactagagagctacaagggaattggcgactcaaactgtgctctctctcttctgtcaaatccacatcaaccacatgacaacaacaacaacaacaacaacaacagcaacaacaacaacaatacatggcgagcttcttcaggttttggcccgatgacggttacaatggctcaaccaccacctgcacctagccagcatcagtatctgaacccgccttgggtattcaaggacaatgataatgatatgtctcctgttttgaatttaggtcgatacaccgagccagataattgtcagataagtagtggcacggcaatgggtgagttcgagttatctgatcaccatcatcaaagtaggagacagtacatggaagatgagaacacaagggcttatgactcttcttctcaccataccaactggtctctctga

SEQ ID NO: 528 - protein, 375 aa, Arabidopsis thaliana
MEMGSNSGPGHGPGQAESGGSSTESSSFSGGLMFGQKIYFEDGGGGSGSSSSGGRSNRRVRGGGSGQSGQIPRCQVEGCGMDLTNAKGYYSRHRVCGVHSKTPKVTVAGIEQRFCQQCSRFHQLPEFDLEKRSCRRRLAGHNERRRKPQPASLSVLASRYGRIAPSLYENGDAGMNGSFLGNQEIGWPSSRTLDTRVMRRPVSSPSWQINPMNVFSQGSVGGGGTSFSSPEIMDTKLESYKGIGDSNCALSLLSNPHQPHDNNNNNNNNSNNNNNTWRASSGFGPMTVTMAQPPPAPSQHQYLNPPWVFKDNDNDMSPVLNLGRYTEPDNCQISSGTAMGEFELSDHHHQSRRQYMEDENTRAYDSSSHHTNWSL

SEQ ID NO: 529 - DNA, 558 bp, Arabidopsis thaliana
atgactcgaccgtcaagattacttgagacggcggcgccaccaccacaaccgtcggaggagatgatcgcagcggaatccgacatggtggtgatcttgtcggctcttctttgcgctcttatctgcgttgctggtctcgccgccgtcgtacgatgcgcttggctccggcggtttacagccggaggagattcgccgtcaccgaacaaaggcttgaaaaagaaagctcttcagtctcttccaagatccactttcaccgccgcggaatcaacctccggcgccgccgctgaagagggagactcgacggaatgtgctatttgcctcactgacttcgccgacggtgaagaaataagagtgcttcctctttgtggtcattctttccacgtggagtgtattgacaaatggctagtttctaggtcttcttgtccttcttgtcgcaggattcttacgccggtgagatgtgaccggtgtggtcatgcttctacggcggagatgaaagatcaagctcatcgtcatcaacatcaccaacactcttctactaccattcctacgtttcttccttaa

SEQ ID NO: 530 - protein, 185 aa, Arabidopsis thaliana
MTRPSRLLETAAPPPQPSEEMIAAESDMVVILSALLCALICVAGLAAVVRCAWLRRFTAGGDSPSPNKGLKKKALQSLPRSTFTAAESTSGAAAEEGDSTECAICLTDFADGEEIRVLPLCGHSFHVECIDKWLVSRSSCPSCRRILTPVRCDRCGHASTAEMKDQAHRHQHHQHSSTTIPTFLP

SEQ ID NO: 531 - DNA, 708 bp, Arabidopsis thaliana
atggagtggtcaacaacgagcaacgtagaaaacgtgagagtagctttcatgccaccgccatggccggagtctagttcctttaactcgctccacagcttcaactttgatccttacgcaggaaattcatatacgcctggcgatacacaaaccggaccggttatctctgtaccggaatcagaaaagatcatgaatgcgtaccgatttccgaacaacaacaatgagatgataaaaaagaagagactaacgagtggacaattagcttcacttgagcgaagttttcaagaagagatcaaattagattcagacaggaaggtgaagctgtcgagagagctcggtctgcagccacgtcagatagcagtttggttccaaaaccgccgtgcacggtggaaggcgaagcagcttgagcagttgtacgactcgcttagacaagagtacgacgtcgtttctagggagaaacaaatgttacacgatgaggtgaagaagctgagagctttactaagagaccagggtttgatcaagaagcaaatctctgccgggaccatcaaagtttccggtgaggaagacacggtggagatttcatcggtggtggtagctcatccaagaacggagaatatgaacgcaaatcaaatcaccggagggaatcaagtttacggtcaatacaacaatccgatgctggttgcttcctctggctggccgtcatacccctga

SEQ ID NO: 532 - protein, 235 aa, Arabidopsis thaliana
MEWSTTSNVENVRVAFMPPPWPESSSFNSLHSFNFDPYAGNSYTPGDTQTGPVISVPESEKIMNAYRFPNNNNEMIKKKRLTSGQLASLERSFQEEIKLDSDRKVKLSRELGLQPRQIAVWFQNRRARWKAKQLEQLYDSLRQEYDVVSREKQMLHDEVKKLRALLRDQGLIKKQISAGTIKVSGEEDTVEISSVVVAHPRTENMNANQITGGNQVYGQYNNPMLVASSGWPSYP

SEQ ID NO: 533 - DNA, 978 bp, Arabidopsis thaliana
atgcatagtttgaatgaaacagtaattcctgatgttgattacatgcagtctgatagagggcatatgcatgctgctgcctctgattccagtgatcgatcaaaggataagttggatcaaaagacccttcgtaggcttgctcaaaatcgtgaggcagcaagaaaaagcagattgaggaagaaggcgtatgttcagcagctggaagatagtcgattaaagctgactcaagttgagcaggagctgcaaagagcaagacagcagggagttttcatctcaagttcaggagaccaagctcattctactggtggcaatggtggggctttggcatttgatgcagaacactcacgatggcttgaagaaaagaacaggcaaatgaacgagctgagatctgccctgaatgctcatgcaggtgatactgagctccggataattgtggatggagtgatggctcactatgaggagcttttcaggattaagagcaatgcatctaagaatgatgtcttccacttgttatctggaatgtggaaaacaccagctgagcgatgtttcttgtggcttggcgggttcccgtcatccgaacttctcaagcttcttgcgaatcagctagagcccatgacagaacgacaggtaatgggcatcaatagcttgcagcagacgtcgcagcaggcagaagatgctttatctcaagggatggagagtttacagcaatccctagctgatactttatccagtggaactcttggttccagttcatcggataatgtcgcgagctacatgggtcagatggccatggcaatgggcaagttaggcaccctcgaaggattcatacgccaggctgataacttgaggctgcaaacactacaacagatgcttcgagtattaacaacacgtcagtcagctcgtgctcttcttgctatacacgattattcatctcgattacgtgctcttagttccttgtggcttgcccggccaagagagtga

SEQ ID NO: 534 - protein, 325 aa, Arabidopsis thaliana
MHSLNETVIPDVDYMQSDRGHMHAAASDSSDRSKDKLDQKTLRRLAQNREAARKSRLRKKAYVQQLEDSRLKLTQVEQELQRARQQGVFISSSGDQAHSTGGNGGALAFDAEHSRWLEEKNRQMNELRSALNAHAGDTELRIIVDGVMAHYEELFRIKSNASKNDVFHLLSGMWKTPAERCFLWLGGFPSSELLKLLANQLEPMTERQVMGINSLQQTSQQAEDALSQGMESLQQSLADTLSSGTLGSSSSDNVASYMGQMAMAMGKLGTLEGFIRQADNLRLQTLQQMLRVLTTRQSARALLAIHDYSSRLRALSSLWLARPRE

SEQ ID NO: 535 - DNA, 1394 bp, Arabidopsis thaliana
taatttctctacttcagatttttttctccttagattaatttaattgagttattgtacatccctcaagctaagattctggttttgtgagttgagtggatgagaagaggagagattaactaaattagggtttcaattgtttactttttgtttgctttttatatcaagtaatggatcaggtctctcgctctcttcctccaccttttctctcaagagatctccatcttcacccacaccatcaattccagcatcagcagcagcagcagcaacagaatcacggccacgatatagaccagcaccgaatcggtgggctaaaacgtgaccgagatgctgatatcgatcccaacgagcactcttcagccggaaaagatcaaagtactcctggctccggtggagaaagcggcggcggaggaggaggagataatcacatcacgagaaggccacgtggcagaccagcgggatctaagaacaaaccaaaaccgccaatcatcatcactcgagacagcgcaaacgctctcaaatctcatgtcatggaagtagcaaacggatgtgacgtcatggaaagtgtcaccgtcttcgctcgccgtcgccaacgtggcatctgcgttttgagcggaaacggcgccgttaccaacgttaccataagacaaccagcttcagtacctggtggtggctcatctgtcgttaacttacacggacgtttcgagattctttctctctcgggatcattccttcctcctccggctccaccagctgcgtcaggtctaacgatttacttagccggtggtcagggacaggttgttggaggaagcgtggttggtccactcatggcttcaggacctgtagtgattatggcagcttcgtttggaaacgctgcgtatgagagactgccgttggaggaagacgatcaagaagagcaaacagctggagcggttgctaataatatcgatggaaacgcaacaatgggtggtggaacgcaaacgcaaactcagacgcagcagcaacagcaacaacagttgatgcaagatccgacgtcgtttatacaagggttgcctccgaatcttatgaattctgttcaattgccagctgaagcttattggggaactccgagaccatctttctaaatcgcgaagaaaaaacaagttagatacgttcgttgtttttaatttataatctctcttctgtcaagttttaattttctttttcttcttctttgttttctaaagataattgtagtctttgacgaagattcgtggtacgtatgaatcgaagagaatcgttttggtcatgggattgctcgatctattaggtttgagagggggtttgtgttttgcgttgactagcagattataaaattgttgattttcgagtttttattttcatgtgttggtgataaa

SEQ ID NO: 536 - protein, 317 aa, Arabidopsis thaliana
MDQVSRSLPPPFLSRDLHLHPHHQFQHQQQQQQQNHGHDIDQHRIGGLKRDRDADIDPNEHSSAGKDQSTPGSGGESGGGGGGDNHITRRPRGRPAGSKNKPKPPIIITRDSANALKSHVMEVANGCDVMESVTVFARRRQRGICVLSGNGAVTNVTIRQPASVPGGGSSVVNLHGRFEILSLSGSFLPPPAPPAASGLTIYLAGGQGQVVGGSVVGPLMASGPVVIMAASFGNAAYERLPLEEDDQEEQTAGAVANNIDGNATMGGGTQTQTQTQQQQQQQLMQDPTSFIQGLPPNLMNSVQLPAEAYWGTPRPSF

SEQ ID NO: 537 - DNA, 1242 bp, Arabidopsis thaliana
cagatctgttctttacaccaaattgagtactgaagatcttgttgagtgaattaaagagatgagatcaggagaatgtgatgaagaggagattcaagcaaagcaagaaagagatcaaaatcaaaatcatcaagtaaacttaaaccacatgttgcaacaacaacagccgagttcggtatcatcttcaaggcaatggacttcagcttttaggaatccaagaatcgttcgagtctcaagaacattcggtggcaaagacagacacagcaaagtatgtacagtccgtggtcttcgagaccggaggataaggttgtccgtacctacagctattcaactctacgaccttcaagatcgattagggctgagtcagccaagcaaagtcattgattggttactcgaagcagcaaaagatgacgtagacaagctacctcctctacaattcccacatggatttaaccagatgtatccaaatctcatcttcggaaactccgggtttggagaatctccatcttcaactacatcaacaacgtttccaggaaccaatctcgggttcttggaaaattgggatcttggtggttcttcaagaacaagagcaagattaaccgatacaactacgacccaaagagaaagttttgatcttgataaaggaaaatggatcaaaaacgacgagaatagtaatcaagatcatcaagggtttaacaccaatcatcaacaacaatttcctctgaccaatccgtacaacaacacttcagcttattacaaccttggacatcttcaacaatcgttagaccaatctggtaataacgttactgtcgcaatatctaatgttgctgctaataataacaataatctcaatttgcatcctccttcctcgtctgccggagatggatctcagctttttttcggtcctactcctccggcaatgagctctctattcccgacatacccttcgtttcttggagcttctcatcatcatcatgtcgtcgatggagccggtcatcttcagctctttagctcgaattcaaataccgcatcgcagcaacacatgatgccgggtaatacgagtttgattagaccatttcatcatttgatgagctcgaatcatgatacggatcatcatagtagcgataatgaatcagattcttgaatgattttatatatctacactatacattgaaaatgttatatgtatacgtattcttctatattttgatatatatgcgtattgttggattggtttatgtatct

SEQ ID NO: 538 - protein, 360 aa, Arabidopsis thaliana
MRSGECDEEEIQAKQERDQNQNHQVNLNHMLQQQQPSSVSSSRQWTSAFRNPRIVRVSRTFGGKDRHSKVCTVRGLRDRRIRLSVPTAIQLYDLQDRLGLSQPSKVIDWLLEAAKDDVDKLPPLQFPHGFNQMYPNLIFGNSGFGESPSSTTSTTFPGTNLGFLENWDLGGSSRTRARLTDTTTTQRESFDLDKGKWIKNDENSNQDHQGFNTNHQQQFPLTNPYNNTSAYYNLGHLQQSLDQSGNNVTVAISNVAANNNNNLNLHPPSSSAGDGSQLFFGPTPPAMSSLFPTYPSFLGASHHHHVVDGAGHLQLFSSNSNTASQQHMMPGNTSLIRPFHHLMSSNHDTDHHSSDNESDS

SEQ ID NO: 539 - DNA, 826 bp, Arabidopsis thaliana
gaattgaacttggaccagcacagcaacaacccaaccccaatgaccagctcagtcatagtagccggcgccggtgacaagaacaatggtatcgtggtccagcagcaaccaccatgtgtggctcgtgagcaagaccaatacatgccaatcgcaaacgtcataagaatcatgcgtaaaaccttaccgtctcacgccaaaatctctgacgacgccaaagaaacgattcaagaatgtgtctccgagtacatcagcttcgtgaccggtgaagccaacgagcgttgccaacgtgagcaacgtaagaccataactgctgaagatatcctttgggctatgagcaagcttgggttcgataactacgtggaccccctcaccgtgttcattaaccggtaccgtgagatagagaccgatcgtggttctgcacttagaggtgagccaccgtcgttgagacaaacctatggaggaaatggtattgggtttcacggcccatctcatggcctacctcctccgggtccttatggttatggtatgttggaccaatccatggttatgggaggtggtcggtactaccaaaacgggtcgtcgggtcaagatgaatccagtgttggtggtggctcttcgtcttccattaacggaatgccggcttttgaccattatggtcagtataagtgaagaaggagttattcttcatttttatatctattcaaaacatgtgtttcgatagatattttatttttatgtcttatcaataacatttctatataatgttgcttctttaaggaaaagtgttgtatgtcaatactttatgagaaactgatttatatatgcaaat

SEQ ID NO: 540 - protein, 208 aa, Arabidopsis thaliana
MTSSVIVAGAGDKNNGIVVQQQPPCVAREQDQYMPIANVIRIMRKTLPSHAKISDDAKETIQECVSEYISFVTGEANERCQREQRKTITAEDILWAMSKLGFDNYVDPLTVFINRYREIETDRGSALRGEPPSLRQTYGGNGIGFHGPSHGLPPPGPYGYGMLDQSMVMGGGRYYQNGSSGQDESSVGGGSSSSINGMPAFDHYGQYK

SEQ ID NO: 541 - DNA, 1500 bp, Arabidopsis thaliana
aatcgaccattcacaacgatgacattcaaacactcttcagtttcccttccttcttgattcgtcctctccactatttttctcaatttctttaatctctctctttctctctctacttcctcttcctcttcttcttcttcttcttcttcatctatggaccctttagcttcccaacatcaacacaaccatctggaagataataaccaaaccctaacccataataatcctcaatccgattccaccaccgactcatcaacttcctccgctcaacgcaaacgcaaaggcaaaggtggtccggacaactccaagttccgttaccgtggcgttcgacaaagaagctggggcaaatgggtcgccgagatccgagagccacgtaagcgcactcgcaagtggcttggtactttcgcaaccgccgaagacgccgcacgtgcctacgaccgggctgccgtttacctatacgggtcacgtgctcagctcaacttaaccccttcgtctccttcctccgtctcttcctcttcctcctccgtctccgccgcttcttctccttccacctcctcttcctccactcaaaccctaagacctctcctccctcgccccgccgccgccaccgtaggaggaggagccaactttggtccgtacggtatcccttttaacaacaacatcttccttaatggtgggacctctatgttatgccctagttatggttttttccctcaacaacaacaacaacaaaatcagatggtccagatgggacaattccaacaccaacagtatcagaatcttcattctaatactaacaataacaagatttctgacatcgagctcactgatgttccggtaactaattcgacttcgtttcatcatgaggtggcgttagggcaggaacaaggaggaagtgggtgtaataataatagttcgatggaggatttgaactctctagctggttcggtgggttcgagtctatcaataactcatccaccgccgttggttgatccggtatgttctatgggtctggatccgggttatatggttggagatggatcttcgaccatttggccttttggaggagaagaagaatatagtcataattgggggagtatttgggattttattgatcccatcttgggggaattctattaatttgtttttgtggaagatcatattatatacgatgagcatccctaaggtcggtcaagagcattggagattcattgttgagaggaatcaaagagattgcattctatgaggagctctgcatgcaaaattttggaggatttttttactacctatagagataaataagagggtatttttattatttttttgaagatttttattttcaaggaattcgtaaaagagattacggttccaataaagtatgtatatgtggaagagaatcggaggagatggtggaaagttgtatgggaattttattggttcaacacttccttcacagtgtgcctaccttaatatataattattgataggatatgataatttctg

SEQ ID NO: 542 - protein, 328 aa, Arabidopsis thaliana
MDPLASQHQHNHLEDNNQTLTHNNPQSDSTTDSSTSSAQRKRKGKGGPDNSKFRYRGVRQRSWGKWVAEIREPRKRTRKWLGTFATAEDAARAYDRAAVYLYGSRAQLNLTPSSPSSVSSSSSSVSAASSPSTSSSSTQTLRPLLPRPAAATVGGGANFGPYGIPFNNNIFLNGGTSMLCPSYGFFPQQQQQQNQMVQMGQFQHQQYQNLHSNTNNNKISDIELTDVPVTNSTSFHHEVALGQEQGGSGCNNNSSMEDLNSLAGSVGSSLSITHPPPLVDPVCSMGLDPGYMVGDGSSTIWPFGGEEEYSHNWGSIWDFIDPILGEFY

SEQ ID NO: 543 - DNA, 897 bp, Arabidopsis thaliana
ccacgcgtccgctcacatgaacaaaggagcttggactaaagaagaagatcagcttcttgttgattacatccgtaaacacggtgaaggttgctggcgatctctccctcgcgccgctggattacaaagatgtggtaagagttgtagattgagatggatgaattatctaagaccagatctcaaaagaggcaattttactgaagaagaagatgaactcatcatcaagctccatagcttgctcggtaacaaatggtctttaatagctgggagattaccaggaagaacagataacgagatcaagaactattggaacactcatatcaagaggaagcttctcagccgtgggattgatccaaactctcaccgtctgatcaacgaatccgtcgtgtctccgtcgtctcttcaaaacgatgtcgttgagactatacatcttgatttctctggaccggttaaaccggaaccggtgcgtgaagagattggtatggttaataattgtgagagtagtggaacgacgtcggagaaggattatgggaacgaggaagattgggtgttgaatttggaactctctgttggaccgagttatcggtacgagtcgactcggaaagtgagtgttgttgactcggctgagtcgactcgacggtggggttccgagttgtttggagctcatgagagtgatgcggtgtgtttgtgttgtcggattgggttgtttcgtaatgagtcgtgtcggaattgtcgggtttctgatgttagaactcattagagagtcaatcgagaattctttaggaatctttttatatatttagatcgtcaattgtgttttttttttgttcacatttgttatgtaacatcaagtaagaaactagcataattatttgatggcaaagccaaaagattgtgctc

SEQ ID NO: 544 - protein, 246 aa, Arabidopsis thaliana
MNKGAWTKEEDQLLVDYIRKHGEGCWRSLPRAAGLQRCGKSCRLRWMNYLRPDLKRGNFTEEEDELIIKLHSLLGNKWSLIAGRLPGRTDNEIKNYWNTHIKRKLLSRGIDPNSHRLINESVVSPSSLQNDVVETIHLDFSGPVKPEPVREEIGMVNNCESSGTTSEKDYGNEEDWVLNLELSVGPSYRYESTRKVSVVDSAESTRRWGSELFGAHESDAVCLCCRIGLFRNESCRNCRVSDVRTH

SEQ ID NO: 545 - DNA, 2299 bp, Arabidopsis thaliana
  misc_feature (32)..(152): n=a,t,c or g
aaaaaaaaaggggagagatttagttttatccnncagngcctgaantacgttctgcaatcaanacggacataaccgnccgttgtgtcctgtttataaagttttgctttttttattttctccantgatgggtcttttctttcttctctctctngtgtttctttcatggggttaagactagtgtttaccgcgtgaaggtttttttttctttctattttctttcatttcctctccttctacttcttcttctccagttctcatctgggttcttcaatggcgagtgttgaaggtgatgatgatttcggaagttcttcgtcaaggtcttatcaagatcaactatacacagagctatggaaagtttgtgcaggtccattagtggaagttcctcgtgctcaagagagagttttctacttccctcagggtcacatggaacaacttgtggcgtcaactaatcaaggaatcaattcagaagaaatacctgtttttgatcttcctccaaagatactttgtcgagttcttgatgtcactttaaaggcggagcatgaaacagatgaggtttacgctcagatcacattacaaccagaggaagatcaaagtgaaccaacaagtcttgatccacctattgttggaccaactaagcaagagtttcattcgtttgttaagattttaacggcttcagatacaagcactcatggtggattctctgttcttcgtaaacacgccactgaatgcttgccttctttggatatgacacaagctactcctactcaagaacttgtgactagagatcttcatggctttgaatggaggtttaagcatatattcagaggacaaccacggaggcatttgcttactacgggttggagtacatttgtatcctcgaaaagacttgtagctggagatgcttttgtgttcttgaggggtgagaatggggatttacgggttggagtgagacgattagctcggcatcaaagcacaatgcctacttcggttatttcaagtcagagcatgcatttgggagttcttgctacagcttctcatgctgtgcgtacaacaacaatctttgttgtcttttacaagcctaggataagccaattcatagttggggtgaacaagtatatggaagctataaagcatggattttctctcggtacccgattcagaatgaggtttgaaggagaagagtctcctgagagaatatttactggtacgattgtgggaagtggagatctatcttcacaatggccagcttctaaatggaggtcattgcaggtacaatgggatgagccaacaacagttcagagaccagataaagtctcaccatgggagatagagcctttcttggcaacttccccaatttcaactcctgctcaacaaccacaatcgaaatgcaagcggtcaagacccatcgagccatcagttaaaacaccagccccacctagtttcttgtacagcctccctcagagccaagattccattaatgcatcccttaaactgtttcaagatccatcacttgagagaatttcaggtggatactcctcaaacaacagcttcaaacccgagactcctcctcctccaacgaattgtagctataggttgtttggatttgatctcacaagcaattctcctgctccaatccctcaagacaagcaaccgatggatacttgtggagctgccaagtgtcaagaacccatcactccaacctcaatgagtgagcagaagaagcaacaaacatcaagaagtcgaactaaagtgcaaatgcaaggcattgcggttggtcgtgcggttgatttaacactgttgaaatcttacgatgaactgattgatgagcttgaggagatgtttgagattcaaggacagcttcttgcccgagacaaatggatcgttgtcttcactgatgatgaaggagatatgatgcttgctggtgatgatccgtggaatgagttttgcaagatggcaaagaagatatttatatattcgagcgatgaggttaagaaaatgacaacgaaactgaagatttcttcgtcgttagagaatgaggaatatggtaatgaatcattcgaaaatcgtagtagggggtgagagttttagctgttaattaaggttaattcggcgacgtcgttttagtgcgtaagtgtctaaagactttttttttagtctgtgtatataaagtcttgtcctctttttcatgtcaatttttcaagttggcgatttaatatttcggttttgggacagtggttgatggggcggttttacattttttatgtgtatgtacttgttccaaaaccattcaattttcaaa

SEQ ID NO: 546 - protein, 602 aa, Arabidopsis thaliana
MASVEGDDDFGSSSSRSYQDQLYTELWKVCAGPLVEVPRAQERVFYFPQGHMEQLVASTNQGINSEEIPVFDLPPKILCRVLDVTLKAEHETDEVYAQITLQPEEDQSEPTSLDPPIVGPTKQEFHSFVKILTASDTSTHGGFSVLRKHATECLPSLDMTQATPTQELVTRDLHGFEWRFKHIFRGQPRRHLLTTGWSTFVSSKRLVAGDAFVFLRGENGDLRVGVRRLARHQSTMPTSVISSQSMHLGVLATASHAVRTTTIFVVFYKPRISQFIVGVNKYMEAIKHGFSLGTRFRMRFEGEESPERIFTGTIVGSGDLSSQWPASKWRSLQVQWDEPTTVQRPDKVSPWEIEPFLATSPISTPAQQPQSKCKRSRPIEPSVKTPAPPSFLYSLPQSQDSINASLKLFQDPSLERISGGYSSNNSFKPETPPPPTNCSYRLFGFDLTSNSPAPIPQDKQPMDTCGAAKCQEPITPTSMSEQKKQQTSRSRTKVQMQGIAVGRAVDLTLLKSYDELIDELEEMFEIQGQLLARDKWIVVFTDDEGDMMLAGDDPWNEFCKMAKKIFIYSSDEVKKMTTKLKISSSLENEEYGNESFENRSRG

SEQ ID NO: 547 - DNA, 1221 bp, Arabidopsis thaliana
cctctttcagagagagaaagagagtcagagagagagagagagagaatgttccatgctaagaaaccttcaagtatgaatggttcatatgagaacagagctatgtgcgttcaaggcgattcaggccttgtcctcaccaccgaccctaaaccgcgtttgcgttggaccgtcgaactccacgagcgttttgtggacgccgtcgctcagctcggcggccccgacaaagcgaccccaaagacgattatgagagttatgggtgtgaagggtcttactctttaccacctaaagagccatcttcagaaattcaggcttggaaagcagccgcacaaggagtacggagatcactccacaaaggaaggttcaagagcttctgccatggatattcagcgcaacgtagcttcttcttctggcatgatgagtcgcaacatgaatgagatgcaaatggaagtgcagagaaggttgcatgaacagctagaggtgcaaagacatctgcaactgaggattgaagcacaaggaaagtacatgcaatctatcttggagagagcttgccaaaccctagccggtgagaacatggcagccgccaccgcagcagccgccgtcggaggaggatacaagggtaatctgggaagttcgagtctttcagcagcggtgggcccacctcctcatcctcttagtttcccgccgtttcaagacctaaacatctatggaaacacaaccgaccaagtcctcgaccatcacaacttccatcatcaaaacatagagaaccatttcacgggtaacaatgctgcagacaccaacatttacttggggaagaagcgacctaatcctaattttggtaacgatgtaaggaaaggactattgatgtggtctgatcaagatcacgatctttccgcaaaccaatcgatcgatgatgagcatagaattcagatacagatggctacacatgtctccacggatttggattctttgtcggagatctacgaaaggaaatcaggtttatcaggtgatgaagggaataatggtgggaaattactggaaaggccatcgcctaggagatcaccattgagtcctatgatgaaccctaatggtggattaatacaaggaagaaactcgccatttgggtgatacaatttattaatttttatctatgagtgatgcatgggaatgtaagaacgagatatatatgttttgtcattgtgagtttgacgtagggtttagagaaaa

SEQ ID NO: 548 - protein, 358 aa, Arabidopsis thaliana
MFHAKKPSSMNGSYENRAMCVQGDSGLVLTTDPKPRLRWTVELHERFVDAVAQLGGPDKATPKTIMRVMGVKGLTLYHLKSHLQKFRLGKQPHKEYGDHSTKEGSRASAMDIQRNVASSSGMMSRNMNEMQMEVQRRLHEQLEVQRHLQLRIEAQGKYMQSILERACQTLAGENMAAATAAAAVGGGYKGNLGSSSLSAAVGPPPHPLSFPPFQDLNIYGNTTDQVLDHHNFHHQNIENHFTGNNAADTNIYLGKKRPNPNFGNDVRKGLLMWSDQDHDLSANQSIDDEHRIQIQMATHVSTDLDSLSEIYERKSGLSGDEGNNGGKLLERPSPRRSPLSPMMNPNGGLIQGRNSPFG

SEQ ID NO: 549 - DNA, 2007 bp, Arabidopsis thaliana
cttcttctccttctctgatcgttcgttttctggacgagagagatggtaaatccgggtcacggaagaggacccgattcgggtactgctgctggtgggtcaaactccgacccgtttcctgcgaatcttcgagttcttgtcgttgatgatgatccaacttgtctcatgatcttagagaggatgcttatgacttgtctctacagagagcagagagcgcattgtctctgcttcggaagaacaaagaatggttttgatattgtcattagtgatgttcatatgcctgacatggatggtttcaagctccttgaacacgttggtttagagatggatttacctgttatcaatctgaatgttttgaaacctttggttatagtgatgtctgcggatgattcgaagagcgttgtgttgaaaggagtgactcacggtgcagttgattacctcatcaaaccggtacgtattgaggctttgaagaatatatggcaacatgtggtgcggaagaagcgtaacgagtggaatgtttctgaacattctggaggaagtattgaagatactggcggtgacagggacaggcagcagcagcatagggaggatgctgataacaactcgtcttcagttaatgaagggaacgggaggagctcgaggaagcggaaggaagaggaagtagatgatcaaggggatgataaggaagactcatcgagtttaaagaaaccacgcgtggtttggtctgttgaattgcatcagcagtttgttgctgctgtgaatcagctaggcgttgacagtgagttaaaaacttgcttgcttatgcatttgtgtgtgtcgattggtaacattgtggaattccagaagtatcggatatatctgagacggcttggaggagtatcgcaacaccaaggaaatatgaaccattcgtttatgactggtcaagatcagagttttggacctctttcttcgttgaatggatttgatcttcaatctttagctgttactggtcagctccctcctcagagccttgcacagcttcaagcagctggtcttggccggcctacactcgctaaaccagggatgtcggtttctccccttgtagatcagagaagcatcttcaactttgaaaacccaaaaataagatttggagacggacatggtcagacgatgaacaatggaaatttgcttcatggtgtcccaacgggtagtcacatgcgtctgcgtcctggacagaatgttcagagcagcggaatgatgttgccagtagcagaccagctacctcgaggaggaccatcgatgctaccatccctcgggcaacagccgatattgtcaagcagcgtttcaagaagaagcgatctcactggtgcgctggcggttagaaacagtatccccgagaccaacagcagagtgttaccaactactcactcggtcttcaataacttccccgcggatctacctcgcagcagcttcccgttggcaagtgccccagggatttcagttccagtatcagtttcttaccaagaagaggtcaacagctcggatgcaaaaggaggttcatcagctgctactgctggatttggtaacccaagctacgacatatttaacgattttccgcagcaccaacagcacaacaagaacatcagcaataaactaaacgattgggatctgcggaatatgggattggtcttcagttccaatcaggacgcagcaactgcaaccgcaaccgcagcattttccacttcggaagcatactcttcgtcttctacgcagagaaaaagacgggaaacggacgcaacagttgtgggtgagcatgggcagaacctgcagtcaccgagccggaatctgtatcatctgaaccacgtttttatggacggtggttcagtcagagtgaagtcagaaagagtggcggagacagtgacttgtcctccagcaaatacattgtttcacgagcagtataatcaagaagatctgatgagcgcatttctcaaacaggtttgattattactcgaatacagtgcactctaaaac

SEQ ID NO: 550 - protein, 644 aa, Arabidopsis thaliana
MVNPGHGRGPDSGTAAGGSNSDPFPANLRVLVVDDDPTCLMILERMLMTCLYREQRAHCLCFGRTKNGFDIVISDVHMPDMDGFKLLEHVGLEMDLPVINLNVLKPLVIVMSADDSKSVVLKGVTHGAVDYLIKPVRIEALKNIWQHVVRKKRNEWNVSEHSGGSIEDTGGDRDRQQQHREDADNNSSSVNEGNGRSSRKRKEEEVDDQGDDKEDSSSLKKPRVVWSVELHQQFVAAVNQLGVDSELKTCLLMHLCVSIGNIVEFQKYRIYLRRLGGVSQHQGNMNHSFMTGQDQSFGPLSSLNGFDLQSLAVTGQLPPQSLAQLQAAGLGRPTLAKPGMSVSPLVDQRSIFNFENPKIRFGDGHGQTMNNGNLLHGVPTGSHMRLRPGQNVQSSGMMLPVADQLPRGGPSMLPSLGQQPILSSSVSRRSDLTGALAVRNSIPETNSRVLPTTHSVFNNFPADLPRSSFPLASAPGISVPVSVSYQEEVNSSDAKGGSSAATAGFGNPSYDIFNDFPQHQQHNKNISNKLNDWDLRNMGLVFSSNQDAATATATAAFSTSEAYSSSSTQRKRRETDATVVGEHGQNLQSPSRNLYHLNHVFMDGGSVRVKSERVAETVTCPPANTLFHEQYNQEDLMSAFLKQV

SEQ ID NO: 551 - DNA, 1212 bp, Arabidopsis thaliana
cttcttcaacttttttttttaacgatggcttcagaggatcaatcggcggcgagatctaccgggaaggtgaactggttcaacgcttctaaaggctatggtttcattactcctgacgatggcagcgtagagcttttcgttcatcaatcttcaattgtctccgaaggttaccggagtttaaccgtcggcgatgcggttgagttcgctattactcagggaagcgacggtaagactaaagccgtcaatgttactgctcctggtggtggttctctcaagaaggagaataactctcgtggtaacggtgctaggcgcggcggcggtggaagcggttgctacaattgcggtgagttaggtcatatctctaaagattgtggtattggtggcggcggcggaggtggtgaacgtagatctagaggaggagaaggttgttacaattgtggtgatactggtcacttcgctagggattgtacttcagctggaaacggtgaccaacgtggagccaccaaaggtggaaacgatggttgctacacttgcggtgatgttggtcacgtggctagggattgtactcagaaatcagttggaaacggagaccaacgtggagcggtcaaaggtggaaacgatggttgctacacttgtggtgatgttggtcactttgctagggattgtactcagaaggttgctgccggaaacgtcagaagcggtggtggtggtagtggaacttgttattcatgcggtggagttggtcacattgcaagagattgtgcgactaagagacagccttctcgtgggtgttaccagtgtggtggttctggtcacttggctcgtgattgtgaccagagaggaagcggtggaggaggtaatgataatgcgtgctacaagtgtggtaaggaaggtcactttgcaagggaatgttcttctgtagcttaatcgatttcctaatcaacaaaacaaaaaaacaagaatgaaattgaatcgagttatatagtttggtatatattactcttcgttttcatttatctttttttttgttgttgatgggaatgaaattgcctggtccttttggtgtgtttttgagcttttattattatacagagtgatcccttttttgttataactattacaagtttttagctttatttgatatggatgctctctccttttcttctatctgtttctggaaattttgacctcatcatattacttatgtcatccaaa

SEQ ID NO: 552 - protein, 299 aa, Arabidopsis thaliana
MASEDQSAARSTGKVNWFNASKGYGFITPDDGSVELFVHQSSIVSEGYRSLTVGDAVEFAITQGSDGKTKAVNVTAPGGGSLKKENNSRGNGARRGGGGSGCYNCGELGHISKDCGIGGGGGGGERRSRGGEGCYNCGDTGHFARDCTSAGNGDQRGATKGGNDGCYTCGDVGHVARDCTQKSVGNGDQRGAVKGGNDGCYTCGDVGHFARDCTQKVAAGNVRSGGGGSGTCYSCGGVGHIARDCATKRQPSRGCYQCGGSGHLARDCDQRGSGGGGNDNACYKCGKEGHFARECSSVA

SEQ ID NO: 553 - DNA, 1213 bp, Arabidopsis thaliana
ccttcctctatataaggaagttcatttcatttggagaggacacgctgacaagctgactctagcagatctggtaccgtcgacggttcttggatttggagtaaactaaagatcatataaaatggaacaaggagatcatcagcagcataagaaagaagaagaagctttgccaccgggtttcagatttcatccgacggatgaggagctaatctcatattacttggttaataagattgccgatcaaaacttcaccgggaaagcaatcgctgacgttgatcttaacaagtccgagccatgggagcttcctgagaaggcgaaaatgggaggaaaagaatggtacttttttagcctccgggaccggaagtacccgacgggagtgaggacgaatagggcgacgaatacaggatattggaaaaccacaggaaaagacaaagagatattcaatagcacaacctcggagttggtcgggatgaagaagactttggtcttttacagaggacgagctcctcgtggggagaagacttgttgggtcatgcatgagtatcgacttcactccaagtcctcatatagaacctccaagcaagacgagtgggtagtgtgtagagtgttcaagaaaacagaagcaaccaagaaatacataagcaccagtagcagcagcacaagtcatcaccacaacaaccacacaagagcctcaatactatcaaccaacaacaataatcctaattactcatcagacctccttcaactcccaccgcatctacaaccacacccgagcctcaatattaaccaatccctcatggcaaacgccgttcacctagctgagctctcaagagtcttccgtgcctctacaagcaccaccatggactcttctcatcagcagctaatgaactacacccacatgcctgtctcagggctcaacctcaaccttggcggtgcactggtccagccgcctcctgttgtgtctcttgaggatgttgccgcggttagtgcttcgtacaatggcgaaaacgggtttggaaatgtggagatgagccagtgcatggacttggatggatactggccatcttattgattggtaattgtcagtttaagttatggtttttatattgtttccatttacttgttggtaaaacgattttggttgttcttgcgaacgctctagacaggcctcgtaccggatcctctagctagagctttcgttcgtatcatcggtttc

SEQ ID NO: 554 - protein, 316 aa, Arabidopsis thaliana
MEQGDHQQHKKEEEALPPGFRFHPTDEELISYYLVNKIADQNFTGKAIADVDLNKSEPWELPEKAKMGGKEWYFFSLRDRKYPTGVRTNRATNTGYWKTTGKDKEIFNSTTSELVGMKKTLVFYRGRAPRGEKTCWVMHEYRLHSKSSYRTSKQDEWVVCRVFKKTEATKKYISTSSSSTSHHHNNHTRASILSTNNNNPNYSSDLLQLPPHLQPHPSLNINQSLMANAVHLAELSRVFRASTSTTMDSSHQQLMNYTHMPVSGLNLNLGGALVQPPPVVSLEDVAAVSASYNGENGFGNVEMSQCMDLDGYWPSY

SEQ ID NO: 555 - DNA, 1130 bp, Arabidopsis thaliana
cataatctcttctctctatatctcttctcttcttcttttaccctgttttttttttcattccacagagcccaggttgattgattttgttattcagagatatggggagaggaaggattgagattaagaagattgagaatatcaacagtcgtcaagtcactttctctaagagacgaaacggtttgatcaagaaggctaaagagctttcgattctctgtgacgccgaggttgctcttatcatcttctccagcaccggcaagatttacgatttctccagcgtctgtatggagcaaattctttctagatatggatacactactgcgtccactgagcataaacaacaaagagaacaccaacttctaatttgtgcttcacatggaaatgaagctgtgttgcgaaatgatgattctatgaagggggaacttgaaagattacagcttgcaattgagagacttaagggtaaggagcttgaaggtatgagtttcccggatcttatttctcttgaaaaccagttgaacgagagcttgcatagtgtcaaggatcaaaagacacaaatcctgctcaaccagattgagagatccaggatacaggagaaaaaagcattggaagaaaaccaaatcttgcgcaaacaggttgagatgttggggagaggttcaggaccaaaagtgttgaatgaaaggcctcaagattctagcccagaagccgatcccgagagctcttcatcagaagaggatgagaatgacaacgaggagcaccattccgacacttccttgcagttggggttgtcgtcgacggggtattgcacaaagagaaagaagccgaagatcgaactggtctgcgataactctgggagtcaagtggcttctgattgatggaatcgattatttttctaattctggttgtttaggggtctctatgtgtcttcttgtttctggctgttcttttgctttatttcatctcaagtagagttttcttaatgtttaggtggaacatttttccataatcaagaagggatttgatcaatcaataacattagattttcttagttaaagacttaaagttgcccacacaccacaccatatgtgattatgatgaatttacattttataaaaaaaaaaaaaaaaaaaaaaaaa

SEQ ID NO: 556 - protein, 256 aa, Arabidopsis thaliana
MGRGRIEIKKIENINSRQVTFSKRRNGLIKKAKELSILCDAEVALIIFSSTGKIYDFSSVCMEQILSRYGYTTASTEHKQQREHQLLICASHGNEAVLRNDDSMKGELERLQLAIERLKGKELEGMSFPDLISLENQLNESLHSVKDQKTQILLNQIERSRIQEKKALEENQILRKQVEMLGRGSGPKVLNERPQDSSPEADPESSSSEEDENDNEEHHSDTSLQLGLSSTGYCTKRKKPKIELVCDNSGSQVASD

SEQ ID NO: 557 - DNA, 1126 bp, Arabidopsis thaliana
atccccacttgttgttcatcaccaagccaagctccatgtcctagtcactccacagattccctatcatcatcaattcgtttcaaacttagttcctttcaaagtcttgtacatatatacacacacacctattattctcttggtgtgtttgtgtgttacatatacgtgtgagtacatactttgttgtaaaagtggatcggaggtatggaaagggaccggttccaccggaaacatcggcggcggcggatgataattcgtcttggaacgagactgatgtcaccgccatggtctccgctctcagccgtgtcatagagaatccgacagacccgccggtcaaacaagagcttgataaatcggatcaacatcaaccagaccaagatcaaccaagaagaagacactatagaggcgtaaggcagagaccatggggtaaatgggcggcagaaatccgcgatccaaagaaagcagcccgtgtctggctcgggactttcgagacggcagaggaagctgctttagcctatgaccgagctgccctcaaattcaaaggcaccaaggctaaactgaacttccctgaacgggtccaaggccctactaccaccacaaccatttctcatgcaccaagaggagttagtgaatccatgaactcacctcctcctcgacctggtccaccttcaactactactacttcgtggccaatgacttataaccaggacatacttcaatacgctcagttgcttacgagtaacaatgaggttgatttatcatactacacgtcgactctcttcagtcaacctttttcaacgccttcttcatcttcttcttcctcccaacagacgcagcaacagcagctacaacaacaacaacagcagcgtgaagaagaagagaagaattatggttacaattattataactacccaagagaataatctaattattattgttggtcgaatcagttttataaatagctatcatagtttcatttttggtttccgtaacctttgttgcatggaaaatatgaatgaacgagggacatgtgtaacaatttgtttgtgtttcgtaaatgttagttgtatttggatttgctgaagtttgattttctgagcataaatcatttgacggtcaaaaaaaaaaa

SEQ ID NO: 558 - protein, 212 aa, Arabidopsis thaliana
MVSALSRVIENPTDPPVKQELDKSDQHQPDQDQPRRRHYRGVRQRPWGKWAAEIRDPKKAARVWLGTFETAEEAALAYDRAALKFKGTKAKLNFPERVQGPTTTTTISHAPRGVSESMNSPPPRPGPPSTTTTSWPMTYNQDILQYAQLLTSNNEVDLSYYTSTLFSQPFSTPSSSSSSSQQTQQQQLQQQQQQREEEEKNYGYNYYNYPRE

SEQ ID NO: 559 - DNA, 891 bp, Arabidopsis thaliana
ccggaaacagaatccaattcaaccaaaccgaatcgaaccgaaccggagtttttatccaatggtgaagcaagcgatgaaggaagaggagaagaagagaaacacggcgatgcagtcaaagtacaaaggagtgaggaagaggaaatggggaaaatgggtatcggagatcagacttccacacagcagagaacgaatttggttaggctcttacgacactcccgagaaggcggcgcgtgctttcgacgccgctcaattttgtctccgcggcggcgatgctaatttcaatttccctaataatccaccgtcgatctccgtagaaaagtcgttgacgcctccggagattcaggaagctgctgctagattcgctaacacattccaagacattgtcaagggagaagaagaatcgggtttagtacccggatccgagatccgaccagagtctccttctacatctgcatctgttgctacatcgacggtggattatgatttttcgtttttggatttgcttccgatgaatttcgggtttgattccttctccgacgacttctctggcttctccggtggtgatcgatttacagagattttacccatcgaagattacggaggagagagtttattagatgaatctttgattctttgggatttttgaattcccaaacataatatttttttagagcgaactgtgagattttccttggagtcatggagaaatctggagattttttgtaacacggagctccaatgacccgggaatttctttcgtttcggatccgaatttgatgtggatcatattcacacctatattttttcatttttttgttgtaaagaaaaatcggataagattctagtaataaatgttaaaagtccatttcattaaaaaaaaaaaaaaaaaaa

SEQ ID NO: 560 - protein, 195 aa, Arabidopsis thaliana
MVKQAMKEEEKKRNTAMQSKYKGVRKRKWGKWVSEIRLPHSRERIWLGSYDTPEKAARAFDAAQFCLRGGDANFNFPNNPPSISVEKSLTPPEIQEAAARFANTFQDIVKGEEESGLVPGSEIRPESPSTSASVATSTVDYDFSFLDLLPMNFGFDSFSDDFSGFSGGDRFTEILPIEDYGGESLLDESLILWDF

SEQ ID NO: 561 - DNA, 1005 bp, Arabidopsis thaliana
atggaatctctcatcaatcccagccatggcggaggaaactacgattctcactcttcttctctcgatagtctcaaaccaagcgtactagtcatcattctcattctcctcatgactcttctcatctccgtttccatttgcttcctcctccgctgtctcaatcgctgtagccaccgctccgttctccctctttcatcttcctcttccgtcgcaaccgtaacttccgattcccgacgattctctggacatcgagtctctcccgaaacagaacggtcctccgtgcttgattcgcttccgattttcaaattctcctccgtcactcgccgatctagctccatgaattccggagattgcgccgtttgtttgtcgaaattcgaaccggaggatcagctccgtcttcttcctctctgttgtcacgcttttcacgccgattgtatcgatatctggctagtctctaaccagacttgtcctctctgtcgctctcctctcttcgcttcagaatctgatctcatgaagtctctcgccgtcgtcggctcaaacaacggcggaggagaaaacagcttccgtctcgaaatcggatccatcagccgtcgtcgtcaaacaccgattccagaatccgttgagcagcatcgaacttactcaatcggttcgttcgattacatagtagacgacgtagattcagaaatctcagagtcaaatttcaaccgtggaaaacaggaagacgcgactacaacaactgccacagcaacggcggttacgactaatccgacgtcgtttgaagctagtttagcggcggatataggtaacgatggttctagaagctggctcaaggattacgttgacagactctcacgaggtatatcgtcgcgtgcaatgtcgtttagaagctctggtagattttttactgggagtagtcgtcggagtgaggaattgacggtgatggatttagaagcgaatcatgccggagaagagataagtgagcttttccggtggctctcaggggtgtga

SEQ ID NO: 562 - protein, 334 aa, Arabidopsis thaliana
MESLINPSHGGGNYDSHSSSLDSLKPSVLVIILILLMTLLISVSICFLLRCLNRCSHRSVLPLSSSSSVATVTSDSRRFSGHRVSPETERSSVLDSLPIFKFSSVTRRSSSMNSGDCAVCLSKFEPEDQLRLLPLCCHAFHADCIDIWLVSNQTCPLCRSPLFASESDLMKSLAVVGSNNGGGENSFRLEIGSISRRRQTPIPESVEQHRTYSIGSFDYIVDDVDSEISESNFNRGKQEDATTTTATATAVTTNPTSFEASLAADIGNDGSRSWLKDYVDRLSRGISSRAMSFRSSGRFFTGSSRRSEELTVMDLEANHAGEEISELFRWLSGV

SEQ ID NO: 563 - DNA, 1071 bp, Arabidopsis thaliana
atgttatgtataataataattgagaatatggaaagagtatgtgagttttgtaaagcgtatagagcagtggtttattgtatagctgatacagcaaatctttgtttaacatgtgatgcaaaggttcattcagctaattcactctcgggacggcatttacgtacggttttatgtgattctggtaagaatcagccttgtgttgtccgatgttttgaccataaaatgtttctttgccatggatgtaatgataagtttcatggtggtggctcttctgagcatcgtagaagggatttgaggtgttatacgggttgtcctcctgctaaagatttcgcggttatgtggggttttcgagttatggatgacgatgatgatgtttcgttagagcaatcttttcgaatggttaaacctaaggtgcaaagagaaggtggttttatcttggaacagattcttgaattggagaaggttcagctcagggaagagaatggtagttcttccttgacagaacgaggtgatccatctccattggagcttcctaagaaacccgaagaacagttaatcgatcttccgcagaccggaaaagagctggttgttgatttttcacacttgtcctcatcttccacacttggtgattccttttgggaatgcaaaagtccatacaataagaacaatcagttgtggcatcaaaatatacaagacattggagtatgtgaagatacaatctgcagtgacgatgacttccaaatacctgacattgatctcactttccggaactttgaagagcaatttggagctgatcctgagccaattgcagatagtaacaacgtgttctttgtttcttcccttgacaaatcacatgagatgaagacattttcttcttcattcaataatcccatatttgcacctaaaccagcttcatcaactatctcattctcaagcagtgaaaccgataacccttatagtcactcagaggaagtaatctcattttgtccctccctctctaacaatacacgtcaaaaggtcatcacaaggctcaaggagaagaagagagcaagagtggaggagaaaaaagcttaa

SEQ ID NO: 564 - protein, 356 aa, Arabidopsis thaliana
MLCIIIIENMERVCEFCKAYRAVVYCIADTANLCLTCDAKVHSANSLSGRHLRTVLCDSGKNQPCVVRCFDHKMFLCHGCNDKFHGGGSSEHRRRDLRCYTGCPPAKDFAVMWGFRVMDDDDDVSLEQSFRMVKPKVQREGGFILEQILELEKVQLREENGSSSLTERGDPSPLELPKKPEEQLIDLPQTGKELVVDFSHLSSSSTLGDSFWECKSPYNKNNQLWHQNIQDIGVCEDTICSDDDFQIPDIDLTFRNFEEQFGADPEPIADSNNVFFVSSLDKSHEMKTFSSSFNNPIFAPKPASSTISFSSSETDNPYSHSEEVISFCPSLSNNTRQKVITRLKEKKRARVEEKKA

SEQ ID NO: 565 - DNA, 724 bp, Arabidopsis thaliana
catcttatccaaagaaaaaatgaatccattttactctacattcccagactcgtttctctcaatctccgatcatagatctccggtttcagacagtagtgagtgttcaccaaagttagcttcaagttgtccaaagaaacgagctgggaggaagaagtttcgtgagacacgtcatccgatttacagaggagttcgtcagaggaattctggtaaatgggtttgtgaagttagagagcctaataagaaatctaggatttggttaggtacttttccgacggttgaaatggctgctcgtgctcatgatgttgctgctttagctcttcgtggtcgctctgcttgtctcaatttcgctgattctgcttggcggcttcgtattcctgagactacttgtcctaaggagattcagaaagctgcgtctgaagctgcaatggcgtttcagaatgagactacgacggagggatctaaaactgcggcggaggcagaggaggcggcaggggagggggtgagggagggggagaggagggcggaggagcagaatggtggtgtgttttatatggatgatgaggcgcttttggggatgcccaacttttttgagaatatggcggaggggatgcttttgccgccgccggaagttggctggaatcataacgactttgacggagtgggtgacgtgtcactctggagttttgacgagtaattttttggctctttttctggataataagtt

SEQ ID NO: 566 - protein, 224 aa, Arabidopsis thaliana
MNPFYSTFPDSFLSISDHRSPVSDSSECSPKLASSCPKKRAGRKKFRETRHPIYRGVRQRNSGKWVCEVREPNKKSRIWLGTFPTVEMAARAHDVAALALRGRSACLNFADSAWRLRIPETTCPKEIQKAASEAAMAFQNETTTEGSKTAAEAEEAAGEGVREGERRAEEQNGGVFYMDDEALLGMPNFFENMAEGMLLPPPEVGWNHNDFDGVGDVSLWSFDE

SEQ ID NO: 567 - DNA, 1296 bp, Arabidopsis thaliana
aaaaaatctattttcttctctttccactatattacaacatttcttcattctcaaatcatcatactaaaaacctaaaaaaagttacatattcattgtatctttgtgagaaaaaaatggattcgaatagtaacaacacgaaatccataaagagaaaagttgtcgaccaacttgtcgaaggctatgaattcgctactcagcttcagcttctcctttctcatcaacactctaaccagtaccacatcgatgagacccgtcttgtttccgggtcgggttcagtttccggtggtccagatcccgttgatgagctcatgtctaagatcttgggatctttccataaaactatatcggttcttgattcttttgatcccgtcgccgtctctgtccccatcgccgtcgagggttcatggaatgcttcatgtggggatgattcggcgactccggtgagttgcaacggtggagattccggtgagagtaagaagaagagattaggggttggtaagggtaaaagaggatgctacactagaaagacgagatcacatacaaggatcgtggaagctaaaagttctgaagacagatatgcttggaggaaatatggacaaaaggagattcttaataccacattcccaagaagttactttagatgcacacacaagccaacgcaaggatgcaaagcaacaaagcaagttcagaaacaggatcaagattctgagatgttccaaatcacatacattggctaccacacatgcactgccaatgaccaaacgcacgcgaagaccgagccttttgatcaagaaatcattatggattcggaaaagacattggctgctagcactgctcagaaccatgtcaatgctatggtgcaagagcaagagaacaacaccagcagtgtgacagcaatagacgcaggcatggttaaggaggaacaaaataacaatggtgatcagagtaaagattattatgagggctcttcgacaggtgaggacttgtcattggtttggcaagagacgatgatgtttgatgatcatcaaaatcactactattgtggtgaaaccagtactacttctcatcaatttggtttcatcgacaacgatgatcagttttcctccttcttcgactcatattgtgctgattatgaaagaacaagtgctatgtgaacatccaaatctggaatgatgaatcagcactaggtcttctctttgagtatgtctagtttaatgtaatatttttgttgtatgtttgataaaaacaccatatatacttctctttttacaccaaaaaaaaaaaaaaaaaaaaaaa

SEQ ID NO: 568 - protein, 346 aa, Arabidopsis thaliana
MDSNSNNTKSIKRKVVDQLVEGYEFATQLQLLLSHQHSNQYHIDETRLVSGSGSVSGGPDPVDELMSKILGSFHKTISVLDSFDPVAVSVPIAVEGSWNASCGDDSATPVSCNGGDSGESKKKRLGVGKGKRGCYTRKTRSHTRIVEAKSSEDRYAWRKYGQKEILNTTFPRSYFRCTHKPTQGCKATKQVQKQDQDSEMFQITYIGYHTCTANDQTHAKTEPFDQEIIMDSEKTLAASTAQNHVNAMVQEQENNTSSVTAIDAGMVKEEQNNNGDQSKDYYEGSSTGEDLSLVWQETMMFDDHQNHYYCGETSTTSHQFGFIDNDDQFSSFFDSYCADYERTSAM

SEQ ID NO: 569 - DNA, 1722 bp, Arabidopsis thaliana
cagattctatggatatgtataacaacaatatagggatgttccggagtttagtttgtagctcggcgcctccatttacagagggacatatgtgttctgattcgcatacggctttgtgcgatgatctgagtagtgatgaggaaatggaaatagaggagcttgagaagaagatctggagagacaagcagcgtttaaagcggctcaaggaaatggcgaagaacggtctaggaacaagattgttgttgaagcagcaacatgatgattttccagagcactctagtaagagaaccatgtacaaggcacaagatgggatcttgaagtacatgtcgaagacaatggagcgatataaagctcaaggttttgtttatgggattgtgttagagaatgggaaaacggtagcgggatcttctgataatctccgtgaatggtggaaagacaaagtgaggtttgataggaacggcccagctgctataatcaagcaccaaagggatatcaatctttctgatggaagtgattcagggtctgaggttggggattctaccgcacagaagttgcttgagcttcaagatactactcttggagctctgttatcggctctgtttcctcactgcaaccctcctcagaggcggtttccgttggagaaaggcgtgacaccgccatggtggccaacggggaaagaagattggtgggatcaactgtctttacccgttgattttcgaggtgttccgccaccttacaagaagcctcatgatctcaagaagctgtggaaaattggtgttttgattggtgtaatcagacatatggcttctgacattagcaacatacccaatctcgtgagacggtctagaagtttgcaggagaaaatgacgtcaagagaaggcgctttatggctcgctgctctttaccgagaaaaggctattgttgatcaaatagccatgtctagagaaaacaacaacacttctaactttcttgttcctgcaaccggtggagacccagatgttttgtttcctgaatctacagactatgatgttgaactgattggtggcactcatcggaccaatcagcagtatcctgaatttgaaaacaactacaactgtgtttacaagagaaagtttgaagaagattttgggatgccaatgcatccaacactcctaacatgtgagaacagtctctgtccttatagccaaccacatatgggatttcttgacaggaacttaagagagaatcaccaaatgacttgtccttataaagtcacttccttctaccaaccaactaaaccctatggtatgacgggtttaatggttccttgtccggattataacgggatgcagcagcaggttcagagctttcaagaccagtttaatcatcccaacgatctctacagaccaaaagctccacaaagaggcaacgatgacttggttgaggatttgaatccttctccttcgacgctgaatcagaatcttggtttagtcttacctactgacttcaatggaggtgaggaaacagtaggaacagagaacaatctgcataatcaagggcaagagttgcccacatcttggattcagtaaagaaagcttcagagttttctttttatgttttctagtctttatagctttgtctcttgcttattctctcattaaacacagtttttgatctctccatttcatagcccatgtagcaatggagaagattaggtttcataataagttaataaccaaattcaaa

SEQ ID NO: 570 - protein, 518 aa, Arabidopsis thaliana
MDMYNNNIGMFRSLVCSSAPPFTEGHMCSDSHTALCDDLSSDEEMEIEELEKKIWRDKQRLKRLKEMAKNGLGTRLLLKQQHDDFPEHSSKRTMYKAQDGILKYMSKTMERYKAQGFVYGIVLENGKTVAGSSDNLREWWKDKVRFDRNGPAAIIKHQRDINLSDGSDSGSEVGDSTAQKLLELQDTTLGALLSALFPHCNPPQRRFPLEKGVTPPWWPTGKEDWWDQLSLPVDFRGVPPPYKKPHDLKKLWKIGVLIGVIRHMASDISNIPNLVRRSRSLQEKMTSREGALWLAALYREKAIVDQIAMSRENNNTSNFLVPATGGDPDVLFPESTDYDVELIGGTHRTNQQYPEFENNYNCVYKRKFEEDFGMPMHPTLLTCENSLCPYSQPHMGFLDRNLRENHQMTCPYKVTSFYQPTKPYGMTGLMVPCPDYNGMQQQVQSFQDQFNHPNDLYRPKAPQRGNDDLVEDLNPSPSTLNQNLGLVLPTDFNGGEETVGTENNLHNQGQELPTSWIQ

SEQ ID NO: 571 - DNA, 897 bp, Arabidopsis thaliana
atgagtttgcctccaggattcaggtttcatcccactgatgaagaactggtggcttactatcttgataggaaggtcaacggccaagccattgagctcgagatcatcccagaagttgatctttataaatgcgagccatgggacttgcctgaaaagtcatttttgccgggaaacgacatggaatggtacttttacagcacaagggataagaagtatccaaatggctctaggacgaaccgtgcgacccgagcgggttactggaaggccacggggaaagatcgtacagtagaatcaaagaagatgaagatgggaatgaagaagacactggtttattatagaggaagggctcctcatggccttcgtactaattgggtcatgcatgaatatcgtctcacgcacgctccttcctcctccttgaaggagtcgtatgcattgtgccgagtgtttaagaagaacatacaaattccaaagagaaaaggggaagaagaagaagcagaagaagagagcactagtgtaggaaaagaagaggaagaagaaaaggagaagaagtggagaaaatgtgatggtaattatattgaagacgagagcttgaaaagagcatccgcggagacatcttcatcagagctaactcaaggggtccttttagacgaagcaaacagctcatccatatttgctcttcatttctcatcttctcttctggacgatcatgatcatcttttctcaaactattctcatcagcttccatatcatcctcctcttcaactccaagatttccctcaactttctatgaacgaagcagagattatgtcaatccaacaagactttcaatgcagagactctatgaacgggacacttgacgaaatcttctcttcttccgccactttccccgcttccctttga

SEQ ID NO: 572 - protein, 298 aa, Arabidopsis thaliana
MSLPPGFRFHPTDEELVAYYLDRKVNGQAIELEIIPEVDLYKCEPWDLPEKSFLPGNDMEWYFYSTRDKKYPNGSRTNRATRAGYWKATGKDRTVESKKMKMGMKKTLVYYRGRAPHGLRTNWVMHEYRLTHAPSSSLKESYALCRVFKKNIQIPKRKGEEEEAEEESTSVGKEEEEEKEKKWRKCDGNYIEDESLKRASAETSSSELTQGVLLDEANSSSIFALHFSSSLLDDHDHLFSNYSHQLPYHPPLQLQDFPQLSMNEAEIMSIQQDFQCRDSMNGTLDEIFSSSATFPASL

SEQ ID NO: 573 - DNA, 1530 bp, Arabidopsis thaliana
  misc_feature (1499)..(1518): n=a,t,c or g
cctctgaggaatcaaatcactcacactccaaaaaaaaatctaaactttctcagagtttaatgaagaagcgcttaaccacttccacttgttcttcttctccatcttcctctgtttcttcttctactactacttcctctcctattcagtcggaggctccaaggcctaaacgagccaaaagggctaagaaatcttctccttctggtgataaatctcataacccgacaagccctgcttctacccgacgcagctctatctacagaggagtcactagacatagatggactgggagattcgaggctcatctttgggacaaaagctcttggaattcgattcagaacaagaaaggcaaacaagtttatctgggagcatatgacagtgaagaagcagcagcacatacgtacgatctggctgctctcaagtactggggacccgacaccatcttgaattttccggcagagacgtacacaaaggaattggaagaaatgcagagagtgacaaaggaagaatatttggcttctctccgccgccagagcagtggtttctccagaggcgtctctaaatatcgcggcgtcgctaggcatcaccacaacggaagatgggaggctcggatcggaagagtgtttgggaacaagtacttgtacctcggcacctataatacgcaggaggaagctgctgcagcatatgacatggctgcgattgagtatcgaggcgcaaacgcggttactaatttcgacattagtaattacattgaccggttaaagaagaaaggtgttttcccgttccctgtgaaccaagctaaccatcaagagggtattcttgttgaagccaaacaagaagttgaaacgagagaagcgaaggaagagcctagagaagaagtgaaacaacagtacgtggaagaaccaccgcaagaagaagaagagaaggaagaagagaaagcagagcaacaagaagcagagattgtaggatattcagaagaagcagcagtggtcaattgctgcatagactcttcaaccataatggaaatggatcgttgtggggacaacaatgagctggcttggaacttctgtatgatggatacagggttttctccgtttttgactgatcagaatctcgcgaatgagaatcccatagagtatccggagctattcaatgagttagcatttgaggacaacatcgacttcatgttcgatgatgggaagcacgagtgcttgaacttggaaaatctggattgttgcgtggtgggaagagagagcccaccctcttcttcttcaccattgtcttgcttatctactgactctgcttcatcaacaacaacaacaacaacctcggtttcttgtaactatttggtctgagagagagagctttgccttctagtttgaatttctatttcttccgcttcttcttcttttttttcttttgttgggttctgcttagggtttgtatttcagtttcagggcttgttcgttggttctgaataatcaatgtctttgccccttttnnaangntncaagntnaaanaaaaaaaaaaaa

SEQ ID NO: 574 - protein, 430 aa, Arabidopsis thaliana
MKKRLTTSTCSSSPSSSVSSSTTTSSPIQSEAPRPKRAKRAKKSSPSGDKSHNPTSPASTRRSSIYRGVTRHRWTGRFEAHLWDKSSWNSIQNKKGKQVYLGAYDSEEAAAHTYDLAALKYWGPDTILNFPAETYTKELEEMQRVTKEEYLASLRRQSSGFSRGVSKYRGVARHHHNGRWEARIGRVFGNKYLYLGTYNTQEEAAAAYDMAAIEYRGANAVTNFDISNYIDRLKKKGVFPFPVNQANHQEGILVEAKQEVETREAKEEPREEVKQQYVEEPPQEEEEKEEEKAEQQEAEIVGYSEEAAVVNCCIDSSTIMEMDRCGDNNELAWNFCMMDTGFSPFLTDQNLANENPIEYPELFNELAFEDNIDFMFDDGKHECLNLENLDCCVVGRESPPSSSSPLSCLSTDSASSTTTTTTSVSCNYLV

SEQ ID NO: 575 - DNA, 4011 bp, Arabidopsis thaliana
atgggttcttactcagctggcttccctggatccttggactggtttgattttcccggtttaggaaacggatcctatctaaatgatcaacctttgttagatattggatctgttcctcctcctctagacccatatcctcaacagaatcttgcttctgcggatgctgatttctctgattctgttttgaagtacataagccaagttcttatggaagaggacatggaagataagccttgtatgtttcatgatgctttatctcttcaagcagctgagaagtctctctatgaagctctcggcgagaagtacccggttgatgattctgatcagcctctgactactactactagccttgctcaattggttagtagtcctggtggttcttcttatgcttcaagcaccacaaccacttcctctgattcacaatggagttttgattgtttggagaataataggccttcttcttggttgcagacaccgatcccgagtaacttcatttttcagtctacatctactagagccagtagcggtaacgcggttttcgggtcaagttttagcggtgatttggtttctaatatgtttaatgatactgacttggcgttacaattcaagaaagggatggaggaagctagtaaattccttcctaagagctctcagttggttatagataactctgttcctaacagattaaccggaaagaagagccattggcgcgaagaagaacatttgactgaagaaagaagtaagaaacaatctgctatttatgttgatgaaactgatgagcttactgatatgtttgacaatattctgatatttggcgaggctaaggaacaacctgtatgcattcttaacgagagtttccctaaggaacctgcgaaagcttcaacgtttagtaagagtcctaaaggcgaaaaaccggaagctagtggtaacagttatacaaaagagacacctgatttgaggacaatgctggtttcttgtgctcaagctgtttcgattaacgatcgtagaactgctgacgagctgttaagtcggataaggcaacattcttcatcttacggcgatggaacagagagattggctcattattttgctaacagtcttgaagcacgtttggctgggataggtacacaggtttatactgccttgtcttccaagaaaacatctacttctgacatgttgaaagcttatcagacatatatatcagtctgtccgttcaagaaaatcgcaatcatattcgccaaccatagtattatgcggttggcttcaagtgctaatgccaaaaccatccacatcatagattttggaatatctgatggtttccagtggccttctctgattcatcgacttgcttggagacgtggttcatcttgtaagcttcggataaccggtatagagttgcctcaacgtggttttagaccagccgagggagttattgagactggtcgtcgcttggctaagtattgtcagaagttcaatattccgtttgagtacaatgcgattgcgcagaaatgggaatcaatcaagttggaggacttgaagctaaaagaaggcgagtttgttgcggtaaactctttatttcggtttaggaatcttctagatgagacggtggcagtgcatagcccgagagatacggttttgaagctgataaggaagataaagccagacgtgttcatccccgggatcctcagcggatcctacaacgcgcctttctttgtcacgaggtttagagaagttctgtttcattactcatctctgtttgacatgtgtgacacgaatctaacacgggaagatccaatgagggttatgtttgagaaagagttctatgggcgggagatcatgaacgtggtggcgtgtgaggggacggagagagtggagaggccagagagttataagcagtggcaggcgagggcgatgagagccgggtttagacagattccgctggagaaggaactagttcagaaactgaagttgatggtggaaagtggatacaaacccaaagagtttgatgttgatcaagattgtcactggttgcttcagggctggaaaggtagaattgtatacggttcatctatttgggttcctttctttttctatgtgggcagagcaactagggttttgatcatggatccaaacttctctgaatctctaaacggctttgagtattttgatggtaaccctaatttgcttactgatccaatggaagatcagtatccaccaccatctgatactctgttgaaatacgtgagtgagattcttatggaagagagtaatggagattataagcaatctatgttctatgattcattggctttacgaaaaactgaagaaatgttgcagcaagtcattactgattctcaaaatcagtcctttagtcctgctgattcattgattactaattcttgggatgcaagcggaagcatcgatgaatcggcttattcggctgatccgcaacctgtgaatgaaattatggttaagagtatgtttagtgatgcagaatcagctttacagtttaagaaaggggttgaagaagctagtaaattccttcccaatagtgatcaatgggttatcaatctggatatcgagagatccgaaaggcgcgattcggttaaagaagagatgggattggatcagttgagagttaagaagaatcatgaaagggattttgaggaagttaggagtagtaagcaatttgctagtaatgtagaagatagtaaggttacagatatgtttgataaggttttgcttcttgacggtgaatgcgatccgcaaacattgttagacagcgagattcaagcgattcggagtagtaagaacataggagagaaagggaagaagaagaagaagaagaagagtcaagtggttgattttcgtacacttctcactcattgtgcacaagccatttccacaggagataaaaccacggctcttgagtttctgttacagataaggcaacagtcttcgcctctcggtgacgcggggcaaagactagctcattgtttcgctaacgcgcttgaagctcgtctacagggaagtaccggtcctatgatccagacttattacaatgctttaacctcgtcgttgaaggatactgctgcggatacaattagagcgtatcgagtttatctttcttcgtctccgtttgttaccttgatgtatttcttctccatctggatgattcttgatgtggctaaagatgctcctgttcttcatatagttgattttgggattctatacgggtttcaatggccgatgtttattcagtctatatcagatcgaaaagatgtaccgcggaagctgcggattactggtatcgagcttcctcagtgcgggtttcggcccgcggagcgaatagaggagacaggacggagattggctgagtattgtaaacggtttaatgttccgtttgagtacaaagccattgcgtctcagaactgggaaacaatccggatagaagatctcgatatacgaccaaacgaagtcttagcggttaatgctggacttagactcaagaaccttcaagatgaaacaggaagcgaagagaattgcccgagagatgctgtcttgaagctaataagaaacatgaacccggacgttttcatccacgcgattgtcaacggttcattcaacgcacccttctttatctcgcggtttaaagaagcggtttaccattactccgctctcttcgacatgtttgattcgacgttgcctcgggataacaaagagaggattaggttcgagagggagttttacgggagagaggctatgaacgtgatagcgtgcgaggaagctgatcgagtggagaggcctgagacttacaggcaatggcaggttagaatggttagagccgggtttaagcagaaaacgattaagcctgagctggtagagttgtttagaggaaagctgaagaaatggcgttaccataaagactttgtggttgatgaaaatagtaaatggttgttacaaggctggaaaggtcgaactctctatgcttcttcttgttgggttcctgcctag

SEQ ID NO: 576 - protein, 1336 aa, Arabidopsis thaliana
MGSYSAGFPGSLDWFDFPGLGNGSYLNDQPLLDIGSVPPPLDPYPQQNLASADADFSDSVLKYISQVLMEEDMEDKPCMFHDALSLQAAEKSLYEALGEKYPVDDSDQPLTTTTSLAQLVSSPGGSSYASSTTTTSSDSQWSFDCLENNRPSSWLQTPIPSNFIFQSTSTRASSGNAVFGSSFSGDLVSNMFNDTDLALQFKKGMEEASKFLPKSSQLVIDNSVPNRLTGKKSHWREEEHLTEERSKKQSAIYVDETDELTDMFDNILIFGEAKEQPVCILNESFPKEPAKASTFSKSPKGEKPEASGNSYTKETPDLRTMLVSCAQAVSINDRRTADELLSRIRQHSSSYGDGTERLAHYFANSLEARLAGIGTQVYTALSSKKTSTSDMLKAYQTYISVCPFKKIAIIFANHSIMRLASSANAKTIHIIDFGISDGFQWPSLIHRLAWRRGSSCKLRITGIELPQRGFRPAEGVIETGRRLAKYCQKFNIPFEYNAIAQKWESIKLEDLKLKEGEFVAVNSLFRFRNLLDETVAVHSPRDTVLKLIRKIKPDVFIPGILSGSYNAPFFVTRFREVLFHYSSLFDMCDTNLTREDPMRVMFEKEFYGREIMNVVACEGTERVERPESYKQWQARAMRAGFRQIPLEKELVQKLKLMVESGYKPKEFDVDQDCHWLLQGWKGRIVYGSSIWVPFFFYVGRATRVLIMDPNFSESLNGFEYFDGNPNLLTDPMEDQYPPPSDTLLKYVSEILMEESNGDYKQSMFYDSLALRKTEEMLQQVITDSQNQSFSPADSLITNSWDASGSIDESAYSADPQPVNEIMVKSMFSDAESALQFKKGVEEASKFLPNSDQWVINLDIERSERRDSVKEEMGLDQLRVKKNHERDFEEVRSSKQFASNVEDSKVTDMFDKVLLLDGECDPQTLLDSEIQAIRSSKNIGEKGKKKKKKKSQVVDFRTLLTHCAQAISTGDKTTALEFLLQIRQQSSPLGDAGQRLAHCFANALEARLQGSTGPMIQTYYNALTSSLKDTAADTIRAYRVYLSSSPFVTLMYFFSIWMILDVAKDAPVLHIVDFGILYGFQWPMFIQSISDRKDVPRKLRITGIELPQCGFRPAERIEETGRRLAEYCKRFNVPFEYKAIASQNWETIRIEDLDIRPNEVLAVNAGLRLKNLQDETGSEENCPRDAVLKLIRNMNPDVFIHAIVNGSFNAPFFISRFKEAVYHYSALFDMFDSTLPRDNKERIRFEREFYGREAMNVIACEEADRVERPETYRQWQVRMVRAGFKQKTIKPELVELFRGKLKKWRYHKDFVVDENSKWLLQGWKGRTLYASSCWVPA

SEQ ID NO: 577 - DNA, 1239 bp, Arabidopsis thaliana
caaatatggaatacagctgtgtagacgacagtagtacaacgtcagaatctctctccatctctactactccaaagccgacaacgacgacggagaagaaactctcttctccgccggcgacgtcgatgcgtctctacagaatgggaagcggcggaagcagcgtcgttttggattcagagaacggcgtcgagaccgagtcacgtaagcttccttcgtcgaaatataaaggcgttgtgcctcagcctaacggaagatggggagctcagatttacgagaagcatcagcgagtttggctcggtactttcaacgaggaagaagaagctgcgtcttcttacgacatcgccgtgaggagattccgcggccgcgacgccgtcactaacttcaaatctcaagttgatggaaacgacgccgaatcggcttttcttgacgctcattctaaagctgagatcgtggatatgttgaggaaacacacttacgccgatgagtttgagcagagtagacggaagtttgttaacggcgacggaaaacgctctgggttggagacggcgacgtacggaaacgacgctgttttgagagcgcgtgaggttttgttcgagaagactgttacgccgagcgacgtcgggaagctgaaccgtttagtgataccgaaacaacacgcggagaagcattttccgttaccggcgatgacgacggcgatggggatgaatccgtctccgacgaaaggcgttttgattaacttggaagatagaacagggaaagtgtggcggttccgttacagttactggaacagcagtcaaagttacgtgttgaccaagggctggagccggttcgttaaagagaagaatcttcgagccggtgatgtggtttgtttcgagagatcaaccggaccagaccggcaattgtatatccactggaaagtccggtctagtccggttcagactgtggttaggctattcggagtcaacattttcaatgtgagtaacgagaaaccaaacgacgtcgcagtagagtgtgttggcaagaagagatctcgggaagatgatttgttttcgttagggtgttccaagaagcaggcgattatcaacatcttgtgacaaattctttttttttggtttttttcttcaatttgtttctcctttttcaatattttgtattgaaatgacaagttgtaaattaggacaagacaagaaaaaatgacaactagacaaaatagtttttgtttaaaaaaaaaaaaaaaaaaaa

SEQ ID NO: 578 - protein, 361 aa, Arabidopsis thaliana
MEYSCVDDSSTTSESLSISTTPKPTTTTEKKLSSPPATSMRLYRMGSGGSSVVLDSENGVETESRKLPSSKYKGVVPQPNGRWGAQIYEKHQRVWLGTFNEEEEAASSYDIAVRRFRGRDAVTNFKSQVDGNDAESAFLDAHSKAEIVDMLRKHTYADEFEQSRRKFVNGDGKRSGLETATYGNDAVLRAREVLFEKTVTPSDVGKLNRLVIPKQHAEKHFPLPAMTTAMGMNPSPTKGVLINLEDRTGKVWRFRYSYWNSSQSYVLTKGWSRFVKEKNLRAGDVVCFERSTGPDRQLYIHWKVRSSPVQTVVRLFGVNIFNVSNEKPNDVAVECVGKKRSREDDLFSLGCSKKQAIINIL

SEQ ID NO: 579 - DNA, 840 bp, Arabidopsis thaliana
atggggaggacgacatggttcgacgtcgacgggatgaagaaaggagagtggacggcagaggaagaccagaagctcggcgcttacatcaacgagcatggcgtttgtgattggcgttccctccccaaaagagctggtttgcagagatgtggaaagagctgcagattaaggtggcttaactatctaaagcctgggattagaagaggcaaattcactcctcaagaagaagaagaaatcatccaacttcatgctgttctcggaaacaggtgggcagccatggcgaagaagatgcagaatcgaacagacaatgatatcaagaaccattggaactcttgtctcaagaaaagactttcgagaaagggaatcgaccctatgacccacgagcccatcatcaaacacctcaccgtcaataccactaacgcagattgtggtaactcttccaccacgacgtccccgtcgacgacggaaagctctccttcctccggctcgtctcgtcttcttaacaaactcgccgcaggtatctcatctagacaacatagtctcgataggatcaagtacatcttgtcgaattcaataatcgaaagcagtgatcaagcaaaagaggaagaagaaaaagaagaagaagaagaagaaagagattcaatgatgggtcagaagattgacggtagtgaaggagaagatattcagatttggggcgaggaggaagttaggcgtttaatggagattgatgcaatggatatgtacgagatgacttcgtacgacgctgtcatgtacgagagtagtcacatacttgatcatctcttttgacttaatatagtgtgactgtgtgagtgcatgcatgtt

SEQ ID NO: 580 - protein, 267 aa, Arabidopsis thaliana
MGRTTWFDVDGMKKGEWTAEEDQKLGAYINEHGVCDWRSLPKRAGLQRCGKSCRLRWLNYLKPGIRRGKFTPQEEEEIIQLHAVLGNRWAAMAKKMQNRTDNDIKNHWNSCLKKRLSRKGIDPMTHEPIIKHLTVNTTNADCGNSSTTTSPSTTESSPSSGSSRLLNKLAAGISSRQHSLDRIKYILSNSIIESSDQAKEEEEKEEEEEERDSMMGQKIDGSEGEDIQIWGEEEVRRLMEIDAMDMYEMTSYDAVMYESSHILDHLF

SEQ ID NO: 581 - DNA, 996 bp, Arabidopsis thaliana
atgaagatcaggtgcgacgtctgcgataaagaagaagcgtcggtgttttgcacggccgacgaagcatctctctgcggcggctgcgaccaccaagtccaccacgctaacaaactcgcctctaaacatctccgtttctctctcctttatccttcttcttccaacacctcctctcctctctgcgacatctgtcaggataaaaaagctctgttgttctgtcaacaagatagagctattttatgcaaagattgcgattcatcgatccacgctgcgaacgaacacacaaagaaacacgataggtttcttcttacaggggttaagctctctgcaacatcgtctgtttacaaacctacttcgaaatcttcttcttcttcttcaagcaaccaagatttctctgtccctggatcatcaatctctaatcctcctcctctcaagaaacctctctcagctcctcctcagagcaacaagatccaacccttttcgaagatcaacggcggtgatgcgtcggtgaatcagtggggatccacaagcacgatttctgagtatttgatggatacgttacctggttggcacgttgaggatttcctcgattcctctcttcctacttatggtttctctaagagtggtgatgatgatggagtgttaccatatatggaaccagaagatgacaacaacactaagagaaacaacaacaacaacaacaacaacaacaacaatacagtgtcacttccatctaagaatttagggatttgggtccctcagattccacaaactcttccttcttcatacccaaatcaatacttttctcaagacaacaacatacagtttgggatgtacaacaaagaaacatcaccagaagtagtgtcttttgctccaatacaaaacatgaaacaacaaggacagaacaacaagagatggtatgatgatggtggcttcactgtcccacagatcactcctcctcctctttcttctaataaaaagtttagatctttctggtaa

SEQ ID NO: 582 - protein, 331 aa, Arabidopsis thaliana
MKIRCDVCDKEEASVFCTADEASLCGGCDHQVHHANKLASKHLRFSLLYPSSSNTSSPLCDICQDKKALLFCQQDRAILCKDCDSSIHAANEHTKKHDRFLLTGVKLSATSSVYKPTSKSSSSSSSNQDFSVPGSSISNPPPLKKPLSAPPQSNKIQPFSKINGGDASVNQWGSTSTISEYLMDTLPGWHVEDFLDSSLPTYGFSKSGDDDGVLPYMEPEDDNNTKRNNNNNNNNNNNTVSLPSKNLGIWVPQIPQTLPSSYPNQYFSQDNNIQFGMYNKETSPEVVSFAPIQNMKQQGQNNKRWYDDGGFTVPQITPPPLSSNKKFRSFW

SEQ ID NO: 583 - DNA, 584 bp, Arabidopsis thaliana
ctctctctctcactcttttcttttccgagaacccaacaaaaaaaaagctactattaatccttcccctcgtgaggaaatcatttcttcttgtttctcgagatttattctctttctctctctctttctctgtgtgtttcgtgtcttcagattagttcgatgtttcgttcagacaaggcggaaaaaatggataaacgacgacggagacagagcaaagccaaggcttcttgttccgaagaggtgagtagtatcgaatgggaagctgtgaagatgtcagaagaagaagaagatctcatttctcggatgtataaactcgttggcgacaggtgggagttgatcgccggaaggatcccgggacggacgccggaggagatagagagatattggcttatgaaacacggcgtcgtttttgccaacagacgaagagacttttttaggaaatgattttttttgtttggattaaaagaaaattttcctctccttaattcacaagacaagaaaaaaaggaaatgtacctgtccttgaattactattttggaatgtataattatctatatatataagaagaaaaaattgcttaggaattt

SEQ ID NO: 584 - protein, 94 aa, Arabidopsis thaliana
MFRSDKAEKMDKRRRRQSKAKASCSEEVSSIEWEAVKMSEEEEDLISRMYKLVGDRWELIAGRIPGRTPEEIERYWLMKHGVVFANRRRDFFRK

SEQ ID NO: 585 - DNA, 407 bp, Arabidopsis thaliana
ccagtagttatggataataccaaccgtcttcgtcttcgtcgcggtcccagtcttaggcaaactaagttcactcgatcccgatatgactctgaagaagtgagtagcatcgaatgggagtttatcagtatgaccgaacaagaagaagatctcatctctcgaatgtacagacttgtcggtaataggtgggatttaatagcaggaagagtcgtaggaagaaaggcaaatgagattgagagatactggattatgagaaactctgactatttttctcacaaacgacgacgtcttaataattctccctttttttctacttctcctcttaatctccaagaaaatctaaaattgtaaagaaatcaaaataaaagctttcaatcataaaagtagaacaaatcttgaatgtcttctca

SEQ ID NO: 586 - protein, 112 aa, Arabidopsis thaliana
MDNTNRLRLRRGPSLRQTKFTRSRYDSEEVSSIEWEFISMTEQEEDLISRMYRLVGNRWDLIAGRVVGRKANEIERYWIMRNSDYFSHKRRRLNNSPFFSTSPLNLQENLKL

SEQ ID NO: 587 - DNA, 1246 bp, Arabidopsis thaliana
gtgtttcttctttctgctaaaaggttataatttttgtttcttggtttggtgagaatcttcaagaaactgaaacaaagaaaatggattctagttgcatagacgagataagttcctccacttcagaatctttctccgccaccaccgccaagaagctctctcctcctcccgcggcggcgttacgcctctaccggatgggaagcggcgggagcagcgtcgtgttggatcccgagaacggcctagagacggagtcacgaaagctaccatcttcaaaatacaaaggtgttgttcctcagcctaacggaagatggggagctcagatctacgagaagcaccaacgagtatggctcgggactttcaacgagcaagaagaagctgctcgttcctacgacatcgcagcttgtagattccgtggccgcgacgccgtcgtcaacttcaagaacgttctggaagacggcgatttagcttttcttgaagctcactcaaaggccgagatcgtcgacatgttgagaaaacacacttacgccgacgagcttgaacagaacaataaacggcagttgtttctctccgtcgacgctaacggaaaacgtaacggatcgagtactactcaaaacgacaaagttttaaagacgtgtgaagttcttttcgagaaggctgttacacctagcgacgttgggaagctaaaccgtctcgtgatacctaaacaacacgccgagaaacactttccgttaccgtcaccgtcaccggcagtgactaaaggagttttgatcaacttcgaagacgttaacggtaaagtgtggaggttccgttactcatactggaacagtagtcaaagttacgtgttgaccaagggatggagtcgattcgtcaaggagaagaatcttcgagccggtgatgttgttactttcgagagatcgaccggactagagcggcagttatatattgattggaaagttcggtctggtccgagagaaaacccggttcaggtggtggttcggcttttcggagttgatatctttaatgtgaccaccgtgaagccaaacgacgtcgtggccgtttgcggtggaaagagatctcgagatgttgatgatatgtttgcgttacggtgttccaagaagcaggcgataatcaatgctttgtgacatatttccttttccgattttatgctttcgttttttaatttttttttttgtcaagttgtgtaggttgtgattcatgctaggttgtatttaggaaaagagataagacc

SEQ ID NO: 588 - protein, 352 aa, Arabidopsis thaliana
MDSSCIDEISSSTSESFSATTAKKLSPPPAAALRLYRMGSGGSSVVLDPENGLETESRKLPSSKYKGVVPQPNGRWGAQIYEKHQRVWLGTFNEQEEAARSYDIAACRFRGRDAVVNFKNVLEDGDLAFLEAHSKAEIVDMLRKHTYADELEQNNKRQLFLSVDANGKRNGSSTTQNDKVLKTCEVLFEKAVTPSDVGKLNRLVIPKQHAEKHFPLPSPSPAVTKGVLINFEDVNGKVWRFRYSYWNSSQSYVLTKGWSRFVKEKNLRAGDVVTFERSTGLERQLYIDWKVRSGPRENPVQVVVRLFGVDIFNVTTVKPNDVVAVCGGKRSRDVDDMFALRCSKKQAIINAL

SEQ ID NO: 589 - DNA, 1057 bp, Arabidopsis thaliana
ctttgatctccactatttaagtagacaagaatcataaagaaaatagtgagatgatgatgttagagtcaagaaacagtatgagagcttcaaactcagtcccagatctgtctcttcagatcagtcttcctaactatcacgccggaaaacctcttcacggcggtgaccggagctccacaagcagtgattctggaagcagcctcagtgacctgagccatgagaacaacttcttcaacaaacctctcttgagcttaggatttgaccatcatcatcaaaggcgctcaaacatgttccaacctcaaatctacggtcgagatttcaagagaagctcatcatcaatggttggtcttaaacgaagcattcgtgctccaagaatgagatggacttctactcttcatgctcacttcgtccatgctgttcaacttcttggcggccatgaaagagcaacgcctaaatcagtgttggagctcatgaatgtgaaggatctaaccctagctcatgtcaagagtcacttgcagatgtatagaacagtgaaatgcactgataaaggatcaccaggagaaggaaaggtagagaaagaggcagagcagaggatagaggacaataataataatgaagaagctgatgaaggaactgacacaaattcgccaaactcatcatctgtgcaaaagacccaaagagcttcatggtcatcgacaaaggaagtatctaggagcatatctacacaagcatattctcacttgggaacaactcatcacactaaggccaatgaagagaaagaggataccaacattcatctcaatttggatttcacattgggcggcctagttgggggatggaatatgcggaaccctccagtgatttaacccttctcaagtgctaattgccttaagctacaacaaataagtcagcttaggttaccagttttaacataattttaacttgttttgatcatatgagcttcggaagaatcatattatcatcatatatgaacttctttccaagaatgttctatgagttttttgatatgtataatcaagagaatcgtttgaagtaaaaa

SEQ ID NO: 590 - protein, 270 aa, Arabidopsis thaliana
MMMLESRNSMRASNSVPDLSLQISLPNYHAGKPLHGGDRSSTSSDSGSSLSDLSHENNFFNKPLLSLGFDHHHQRRSNMFQPQIYGRDFKRSSSSMVGLKRSIRAPRMRWTSTLHAHFVHAVQLLGGHERATPKSVLELMNVKDLTLAHVKSHLQMYRTVKCTDKGSPGEGKVEKEAEQRIEDNNNNEEADEGTDTNSPNSSSVQKTQRASWSSTKEVSRSISTQAYSHLGTTHHTKANEEKEDTNIHLNLDFTLGGLVGGWNMRNPPVI

SEQ ID NO: 591 - DNA, 1500 bp, Arabidopsis thaliana
ataaaacgaaaccctatacatataaactaagagcgagaaagacagctagagagagagagagagatgaagaaatggttgggattttcattgacacctcctttgagaatctgcaatagtgaagaagaagaacttaggcatgacggttccgatgtttggagatatgatattaactttgatcatcatcatcatgatgaagacgttccaaaggtggaagatctcctctcaaactctcatcaaaccgagtatcctataaaccataaccaaaccaatgtcaactgcaccactgtggttaacaggttaaacccacccggttaccttctccacgaccaaaccgtagttacaccacattacccgaacctagatccgaaccttagcaatgattatggaggttttgagagggtcggttcggtctcggttttcaaatcttggttagagcaaggcactccagcattcccactctcgagtcattacgttactgaagaggctggtacgagcaataatattagtcattttagtaacgaagagactggttataacaccaatggctcaatgctatcattggctttgagccatggggcttgttctgatttgatcaacgaatcgaatgtatccgcacgggtcgaagaaccggttaaggtagatgagaagcggaagagattggttgttaaacctcaggtaaaggaatccgttcctcggaagtcggttgatagttatggacaaagaacttctcagtatcgtggagttacaaggcatagatggacagggagatatgaagctcacttatgggataatagctgtaagaaggagggacagacaaggagaggaagacaagtgtatcttggagggtatgatgaggaggagaaagcagcgagggcatatgatttagcggctctgaagtattggggtcctaccactcacttaaatttccctttgagtaattacgaaaaggagatcgaggaactcaataacatgaatcggcaagaatttgttgccatgttgaggaggaatagcagcgggttttcgaggggagcttccgtgtatagaggagttacaaggcatcatcaacatggaaggtggcaagccagaattggaagagttgctggaaacaaggacttgtaccttggaacatttagcacgcaagaagaagcagcggaggcgtacgatatcgcggcaattaaattcagaggcctaaacgctgtaaccaatttcgatataaatagatatgacgtgaagaggatatgttcaagctcaacgattgttgatagcgaccaggccaaacattctcccaccagctctggcgccggccactaaccgacaccgtaaactcctcgccggagagactattcccacgtacggttggtttgaggaaataagttcgtccagtctgtttaatcatttatggtttaataaacatatattcctaagtaattgaggccggtctacatatatacaacttttttagcaaattaagttatcagaatccactatatattattctct

SEQ ID NO: 592 - protein, 415 aa, Arabidopsis thaliana
MKKWLGFSLTPPLRICNSEEEELRHDGSDVWRYDINFDHHHHDEDVPKVEDLLSNSHQTEYPINHNQTNVNCTTVVNRLNPPGYLLHDQTVVTPHYPNLDPNLSNDYGGFERVGSVSVFKSWLEQGTPAFPLSSHYVTEEAGTSNNISHFSNEETGYNTNGSMLSLALSHGACSDLINESNVSARVEEPVKVDEKRKRLVVKPQVKESVPRKSVDSYGQRTSQYRGVTRHRWTGRYEAHLWDNSCKKEGQTRRGRQVYLGGYDEEEKAARAYDLAALKYWGPTTHLNFPLSNYEKEIEELNNMNRQEFVAMLRRNSSGFSRGASVYRGVTRHHQHGRWQARIGRVAGNKDLYLGTFSTQEEAAEAYDIAAIKFRGLNAVTNFDINRYDVKRICSSSTIVDSDQAKHSPTSSGAGH

SEQ ID NO: 593 - DNA, 988 bp, Arabidopsis thaliana
gagttatcgagagagagagaaaacatattctgatttaagacatatatagacagcaagaagagatatgaaccttaaggagacggagctttgtcttggcctccccggaggcactgaaaccgttgaaagtccggccaagtcgggtgttgggaacaagagaggcttctccgagaccgttgatctcaaacttaatcttcaatctaacaaacaaggacatgtggatctcaacactaatggagctcccaaggagaagaccttccttaaagacccttctaagcctcctgctaaagcacaagtggtgggttggccaccggtgaggaactaccggaaaaatgttatggctaatcagaagagcggcgaagcagaggaggcaatgagtagtggtggaggaaccgtcgcctttgtgaaggtttccatggatggagctccttatcttcggaaggttgacctcaagatgtacaccagctacaaggatctctctgatgccttggccaaaatgttcagctcctttaccatggggagttatggagcacaagggatgatagatttcatgaacgagagtaaagtgatggatctgttgaacagttctgagtatgttccaagctacgaggacaaagatggtgactggatgctcgttggtgatgtcccctggccgatgtttgtcgagtcatgcaaacgtttgcgcataatgaaaggatccgaagcaattggacttgctccaagagcaatggagaagttcaagaacagatcatgaacaaaaaaaaaagaggacaatatgcattgatttttttttttttggtattgttatgatcatgtgttttaatttaaaatataggaaggatataggaaaatataattgtttacaaaaaaataactttaaatatgtcttttttttttttttgaaattagtctgtgtttttgttttcatctcttaattagtagaaatcattttttaatatgtaattgtgatagtaaatctatagagttcgta

SEQ ID NO: 594 - protein, 228 aa, Arabidopsis thaliana
MNLKETELCLGLPGGTETVESPAKSGVGNKRGFSETVDLKLNLQSNKQGHVDLNTNGAPKEKTFLKDPSKPPAKAQVVGWPPVRNYRKNVMANQKSGEAEEAMSSGGGTVAFVKVSMDGAPYLRKVDLKMYTSYKDLSDALAKMFSSFTMGSYGAQGMIDFMNESKVMDLLNSSEYVPSYEDKDGDWMLVGDVPWPMFVESCKRLRIMKGSEAIGLAPRAMEKFKNRS

SEQ ID NO: 595 - DNA, 2162 bp, Arabidopsis thaliana
aaaaagtcttctcttttataactacgtcagagaactgttatgtctccgacgaatgttcaagtaaccgattaccatctcaaccaatcaaaaacggatacaacaaatctctggtcaaccgacgacgatgcatcggtaatggaagctttcatcggcggcggctccgatcattcttctctttttcctccacttcctcctcctcctcttcctcaagtcaacgaagataatctccagcaacgtctccaagctttaatcgaaggagcaaacgagaactggacttacgccgtgttctggcaatcatctcacggtttcgccggagaagacaacaacaacaacaacacagtgttgttaggttggggagatggttattacaaaggagaagaagagaagtctagaaagaagaaatcaaatccagctagtgcagctgaacaagagcatcgtaagagagtgattagagagctcaactctttaatctccggtggtgtaggaggaggagatgaagctggagatgaagaagttacagatactgaatggttcttcttagtttcaatgacacagagctttgtcaagggtactggtttacctggtcaagctttctcaaattcagacacgatttggttatctggttctaatgctttagctggatcaagttgtgagagagctcgtcaaggtcagatttatgggttacaaacaatggtgtgtgtagcgacagagaatggtgtcgttgagcttggttcgtcggagattattcatcaaagttcagatcttgttgataaagttgacacctttttcaattttaacaatggtggtggtgaatttggttcttgggcgtttaatttgaatccagatcaaggagagaatgatccaggtttgtggattagtgaacctaatggtgttgactctggtcttgtagctgctccggtgatgaataatggtggaaatgactcaacttctaattctgattctcaaccaatttctaagctttgtaatggaagctctgttgaaaaccctaaccctaaagttctgaaatcttgtgaaatggtgaatttcaagaatgggattgagaatggtcaagaagaagatagtagtaataagaagagatcaccggtttcgaataatgaagaagggatgctttcttttacctctgttcttccatgtgactcgaatcactctgatcttgaagcttcagtggctaaagaagctgagagtaacagagttgtggttgaaccggagaagaaaccgaggaaacgagggagaaaaccggcgaatggaagagaagagcctttgaatcatgtagaggcagagagacagagaagagagaagttgaatcagagattctattctttaagagctgtggttcctaatgtgtctaagatggataaagcttctctattaggagatgctatttcgtatatcagtgagcttaagtctaagttgcaaaaggctgaatctgataaagaagagttgcagaagcagattgatgtgatgaataaagaagcgggaaatgcgaaaagttcggtaaaagatcgaaaatgtttgaatcaagaatcgagtgtgttgatagagatggaggttgatgtgaagattattggttgggatgcaatgataaggattcaatgtagtaagaggaatcatcctggtgctaagttcatggaagcacttaaggagttggatttggaagtgaatcatgcgagtttatcggtagtgaatgatcttatgatccaacaagcgactgtgaaaatggggaatcagtttttcacgcaagatcaactcaaggttgctctaacggagaaagttggagaatgtccatgaattgaagtcagcatctttagggctaatacaccggagaatactgcgaaaagtcgaaaacaacgatcatagtataagccgcggtaaaaagtgttaaacctttcacacaagtttctctagtgaatgtagttgtaaactctattgtgtaagggtaattttgtagtacccacttgttgctattgaatgcttgttagagaggattcttagtgtagtatatgattaggttggggtttgttgtttcatgagataaataaatgtgtttgatcaatggttaagtctttggtttgttggtgtatgtatgtaaataaggcttttgttagaaataagacaaatgggactgaagttggagtttaaaa

SEQ ID NO: 596 - protein, 589 aa, Arabidopsis thaliana
MSPTNVQVTDYHLNQSKTDTTNLWSTDDDASVMEAFIGGGSDHSSLFPPLPPPPLPQVNEDNLQQRLQALIEGANENWTYAVFWQSSHGFAGEDNNNNNTVLLGWGDGYYKGEEEKSRKKKSNPASAAEQEHRKRVIRELNSLISGGVGGGDEAGDEEVTDTEWFFLVSMTQSFVKGTGLPGQAFSNSDTIWLSGSNALAGSSCERARQGQIYGLQTMVCVATENGVVELGSSEIIHQSSDLVDKVDTFFNFNNGGGEFGSWAFNLNPDQGENDPGLWISEPNGVDSGLVAAPVMNNGGNDSTSNSDSQPISKLCNGSSVENPNPKVLKSCEMVNFKNGIENGQEEDSSNKKRSPVSNNEEGMLSFTSVLPCDSNHSDLEASVAKEAESNRVVVEPEKKPRKRGRKPANGREEPLNHVEAERQRREKLNQRFYSLRAVVPNVSKMDKASLLGDAISYISELKSKLQKAESDKEELQKQIDVMNKEAGNAKSSVKDRKCLNQESSVLIEMEVDVKIIGWDAMIRIQCSKRNHPGAKFMEALKELDLEVNHASLSVVNDLMIQQATVKMGNQFFTQDQLKVALTEKVGECP

SEQ ID NO: 597 - DNA, 1056 bp, Arabidopsis thaliana
atgggaagaccaccttgctgtgaaaagattggagtgaagaaagggccatggacaccagaggaagacatcatcttggtttcttacatccaagaacatggtcctggaaactggagatctgtcccaacacacacaggtttaagatgtagcaagagctgcagattgagatggactaattatcttcgacccggtattaagcgtggaaattttactgagcatgaagagaagacaattgttcatcttcaagcccttttaggcaacagatgggcagccatagcatcataccttccagaaaggacagacaatgatataaagaactattggaacactcacttgaagaagaagctcaaaaagattaatgaatctggtgaagaagataatgatggtgtctcttcatcaaacactagttcacaaaagaaccatcaaagcactaacaaaggtcaatgggaaagaagacttcagacagacattaacatggcaaaacaagctctttgtgaggccttgtctttagacaaaccatcatccactctttcatcatcttcatcattaccgacaccagtaatcacacaacaaaacatccgtaacttctcatcagctttgcttgaccgttgttatgatccatcctcttcttcttcatctaccacaaccaccactacaagcaacactactaatccatacccatcaggggtatatgcgtcaagtgctgagaacatcgcccggttgcttcaagatttcatgaaagacacacccaaggctttaactttatcatcttcatctccggtttcagagactggaccactcactgctgcagtctcggaagaaggtggagaagggtttgaacaatctttcttcagcttcaattcaatggacgaaactcaaaacttgactcaggagacaagcttcttccatgatcaagtgatcaaaccggaaataacaatggaccaagatcatggtctaatatcacaagggtctctgtctttgtttgagaaatggttatttgatgagcaaagccacgagatggttggtatggcactagcaggacaagaagggatgttctag

SEQ ID NO: 598 - protein, 351 aa, Arabidopsis thaliana
MGRPPCCEKIGVKKGPWTPEEDIILVSYIQEHGPGNWRSVPTHTGLRCSKSCRLRWTNYLRPGIKRGNFTEHEEKTIVHLQALLGNRWAAIASYLPERTDNDIKNYWNTHLKKKLKKINESGEEDNDGVSSSNTSSQKNHQSTNKGQWERRLQTDINMAKQALCEALSLDKPSSTLSSSSSLPTPVITQQNIRNFSSALLDRCYDPSSSSSSTTTTTTSNTTNPYPSGVYASSAENIARLLQDFMKDTPKALTLSSSSPVSETGPLTAAVSEEGGEGFEQSFFSFNSMDETQNLTQETSFFHDQVIKPEITMDQDHGLISQGSLSLFEKWLFDEQSHEMVGMALAGQEGMF

SEQ ID NO: 599 - DNA, 1766 bp, Arabidopsis thaliana
ttccccatttcagaaaatcaaaatgggtggtggtggtgatacaacagataccaatatgatgcagagagttaattcttcttctggtacatcgtcttcttcgatccctaaacacaatcttcacttgaatcctgctcttatccgctctcaccatcacttccgtcaccctttcaccggagctcctccaccgccgattccacccatttctccttactctcagatcccggcgactttacaacctagacattctcgctctatgtcgcaaccgtcttctttcttctcctttgattcattgccgccgttaaatccttctgctccgtcggtttcggtgtcggtggaggagaaaaccggtgccggatttagtccttcgttgcctccgtcaccgtttacgatgtgtcattcttctagctctaggaacgccggagatggagagaatctacctccgagaaagtcgcataggcgttcgaatagtgatgttacttttgggtttagttcaatgatgtctcagaatcaaaagtctcctcctttgagttctttggagagatcgatctctggtgaagatacatcagattggtctaatttggtgaagaaagaaccgagagaaggcttctacaagggaagaaaaccagaggttgaagcagctatggacgatgttttcacggcttatatgaatcttgataacattgatgtcttgaattcttttggaggtgaagatggcaagaatgggaatgagaatgtggaggagatggagagtagtagaggtagtggtacaaagaagacgaatggtggaagtagtagtgattctgaaggagatagcagtgcgagtgggaatgtgaaggttgcgttgagttcttcttcttcaggcgtgaagagaagagcaggtggagatattgctcctactggtagacattacaggagtgtttctatggacagttgtttcatggggaagttgaatttcggcgacgaatcatcgctaaagcttccgccttcttcatcagctaaagtttccccaaccaattcaggtgaagggaattcaagtgcttatagtgttgaatttggaaacagtgagtttactgcagctgaaatgaagaagattgcagctgatgagaaactcgctgagattgtaatggctgaccctaagcgtgttaaaagaatcttggcgaaccgcgtatctgctgcacgttcaaaggagcggaagacgcgatacatggcagagttggaacacaaggtgcagacacttcagactgaagctactacattatcggctcagctcacacatttgcagagagattctatggggttgacaaaccagaacagtgagctgaagtttcgtcttcaagctatggagcagcaagcacaactccgcgatgctctgtcagagaaactgaatgaagaagtccagcggttgaaactggtgataggggagccgaaccgcaggcaaagtgggagcagcagcagcgaatcaaagatgtcactaaacccggagatgtttcagcagcttagcataagtcagttacaacaccaacagatgcagcattccaatcagtgtagcacaatgaaagcaaagcacacttcaaacgactagggtaagtaaaactgcgatccgcagttgtctagttacatatatgataagaatcttttgtgcagagttctgtttttggaagttttaaagaaacatatataaagattatgtccgggaaatttgatcatatttcctgaaacatacacacatatatatagtggtaatggaggactttctttctggacca

SEQ ID NO: 600 - protein, 519 aa, Arabidopsis thaliana
MGGGGDTTDTNMMQRVNSSSGTSSSSIPKHNLHLNPALIRSHHHFRHPFTGAPPPPIPPISPYSQIPATLQPRHSRSMSQPSSFFSFDSLPPLNPSAPSVSVSVEEKTGAGFSPSLPPSPFTMCHSSSSRNAGDGENLPPRKSHRRSNSDVTFGFSSMMSQNQKSPPLSSLERSISGEDTSDWSNLVKKEPREGFYKGRKPEVEAAMDDVFTAYMNLDNIDVLNSFGGEDGKNGNENVEEMESSRGSGTKKTNGGSSSDSEGDSSASGNVKVALSSSSSGVKRRAGGDIAPTGRHYRSVSMDSCFMGKLNFGDESSLKLPPSSSAKVSPTNSGEGNSSAYSVEFGNSEFTAAEMKKIAADEKLAEIVMADPKRVKRILANRVSAARSKERKTRYMAELEHKVQTLQTEATTLSAQLTHLQRDSMGLTNQNSELKFRLQAMEQQAQLRDALSEKLNEEVQRLKLVIGEPNRRQSGSSSSESKMSLNPEMFQQLSISQLQHQQMQHSNQCSTMKAKHTSND

SEQ ID NO: 601 - DNA, 1319 bp, Arabidopsis thaliana
tatccttcgcaagacccttcctctatataaggaagttcatttcatttggagaggacacgctgacaagctgactctagcagatctggtaccgtcgacagtttgagatttgcttcatccggtttttttattttctgcaaaatatgtcactctctcccattttgttcatatataatatgtttgaagtttgatcaacttagtatgcgtttctttttctctctagttcctctgtttcttggtcgatttagtttcgttatggcggacacactgctcaacgcagaagacgaagtaataatctcacgttatctgaagcctatgatcgttaacagagtatcatggcctgatctcttcatcgaagacgcagacgtgttcaacaaggatccatatgtgaagttccatgctgagatccctagcttcgtgatcgttaaaccacgaacaaaggcttgtggtaaaaccgatggatgtgattcgggttgctggaggatcattggtcgtgataagctgataaagtcggaggagactggtaagattctagggttcaagaagatactcaagttctgcctaaagtggaaacctagagaatacaagagaagtttggtaatggaagagtataggcttaccaataacttcaactggaagcaagatcatgtgatttgcaagattcggcttttgtttgaagcagaaattagtttcttgctagccaagcatttctacactacatcagactcacttcctcgaaatgtgctgttgccagcttatggattctgttcaccagataaacaagaggaggacgaattttatccggtgacgataatgatttcagaaggaaaagattggcctagctacgttaccaacaacgtgtattgtctgcatccatcggagcttgtgaatgttcacgatgggaagtttcatgataacggaatctgcatcttcgctaacaggacttgtggtgtaaccgataaatgcaatgaaggttactggaagattaagcaccgtgagaagctgatcatgtcacggtacgggcagaccattggttggaagaaagtttttcagttttatgaaacggagaaagaaagacattttggtaatggagaagaagtgaaggtaacttggactctaaaagagtataggcttaccagaaaaatgaacaagaataaagtggtgtgcgttatcaagtataaggtaaagtgtttaccgaggataactagctagggacttctactcttggtttcatgatcgatgcgaccgctctagacaggcctcgtaccggatcctctagctagagctttcgttcgtatcatcggtttcgacaacgttcgtca

SEQ ID NO: 602 - protein, 336 aa, Arabidopsis thaliana
MRFFFSLVPLFLGRFSFVMADTLLNAEDEVIISRYLKPMIVNRVSWPDLFIEDADVFNKDPYVKFHAEIPSFVIVKPRTKACGKTDGCDSGCWRIIGRDKLIKSEETGKILGFKKILKFCLKWKPREYKRSLVMEEYRLTNNFNWKQDHVICKIRLLFEAEISFLLAKHFYTTSDSLPRNVLLPAYGFCSPDKQEEDEFYPVTIMISEGKDWPSYVTNNVYCLHPSELVNVHDGKFHDNGICIFANRTCGVTDKCNEGYWKIKHREKLIMSRYGQTIGWKKVFQFYETEKERHFGNGEEVKVTWTLKEYRLTRKMNKNKVVCVIKYKVKCLPRITS

SEQ ID NO: 603 - DNA, 1445 bp, Arabidopsis thaliana
tcgaccttcctaatttccaacctctgttcttagcaatatattttttctccaaaaataattctcagtttgattttcttcttctagctcttaagtatatttctttgttgttatttatcttttaatcctttaatctcatctttgtttatctttaatcaaaacccaaaatttacatgggttcttgaaaatctagaagaaataaaggaaacataacaaaaatagaaagaaaaagaagctaatggtcttaaatatggagtctaccggagaagctgttagatcaaccaccggtaacgacggtggtattacggtggttagatccgacgcgccgtcagatttccacgtagctcaaagatcagaaagctcaaaccaatctcccacctctgtcactcctcctccaccacagccatcgtctcatcacacagctcctccgccgctgcaaatttcgacggtgacgactacgactacgacggccgcgatggaaggtatctccggtggactgatgaagaagaagcgtggacggccaaggaagtatggaccggacgggactgttgtagcgttatctcctaaaccgatttcatcagcgccggcgccgtcgcatcttccgccgccgagttcacacgtcatcgatttctccgcttctgagaaacgtagcaaagtgaaaccaacgaactcgtttaacagaacaaagtatcatcaccaagttgagaatttgggtgaatgggctccttgctccgtcggtggtaatttcacacctcatataatcacagtcaacaccggcgaggatgtaacaatgaagataatctcgttttcgcaacaaggacctcgctctatttgtgttctgtcagcaaacggtgttatttcaagcgttacacttcgtcagccagattcctctggcggcacattgacatacgaaggtcggtttgagatattatcattatccgggtcattcatgcctaatgattcaggcggaacacgaagtagaacgggaggaatgagtgtatcgttagcaagtcccgatggacgtgtagtaggcggtggcctcgccggtttactagtagccgcgagtccggttcaggtggttgtaggaagttttttagcgggcactgaccatcaagatcagaaaccgaaaaagaacaaacatgatttcatgttgtcgagtcctaccgctgcaattcctatctctagtgcagctgatcaccggacaatccattcggtctcgtctcttccggtcaataataatacatggcagacttctttagcttccgatccaagaaacaagcataccgatattaatgtcaatgtaacttgaaatccaatctttctctgtattttctgttaacaagtttgatttggttgtttatctacattaggattttactaaaatggtagtattatttatagggttttagggtctttattttggttccactgttgtcacttgtaggata

SEQ ID NO: 604 - protein, 356 aa, Arabidopsis thaliana
MVLNMESTGEAVRSTTGNDGGITVVRSDAPSDFHVAQRSESSNQSPTSVTPPPPQPSSHHTAPPPLQISTVTTTTTTAAMEGISGGLMKKKRGRPRKYGPDGTVVALSPKPISSAPAPSHLPPPSSHVIDFSASEKRSKVKPTNSFNRTKYHHQVENLGEWAPCSVGGNFTPHIITVNTGEDVTMKIISFSQQGPRSICVLSANGVISSVTLRQPDSSGGTLTYEGRFEILSLSGSFMPNDSGGTRSRTGGMSVSLASPDGRVVGGGLAGLLVAASPVQVVVGSFLAGTDHQDQKPKKNKHDFMLSSPTAAIPISSAADHRTIHSVSSLPVNNNTWQTSLASDPRNKHTDINVNVT

SEQ ID NO: 605 - DNA, 1050 bp, Arabidopsis thaliana
gacctctttgatcccttcattccccatcaaacaaccatgtttccttctttcattactcacattcaaagccctaattctcaccatcactactcttcgccttcttttcctttctcttccgattttcttgagagttttgatgaatccttcttgataaaccaattcttgttacagcagcaagatgtagcagcaaatgttgttgaatctccttggaaattttgcaagaagcttgagcttaagaagaagaatgagaagtgtgttgatggaagcacctcacaagaggttcaatggagaaggacggtcaaaaaaagggacaggcatagtaagatctgcacggctcaaggtcctagagaccggaggatgaggctgtctcttcagattgctcgcaagtttttcgatcttcaagacatgttgggtttcgacaaggcgagcaagacgattgaatggcttttctccaaatcaaagacttccatcaaacaacttaaagaaagagtggctgcatcggaaggaggaggaaaggatgaacatctccaggttgatgaaaaggaaaaggatgagacactgaagttgagagtctcaaagagaagaacaaagactatggagagctcttttaagactaaagagtcgagagagagagctagaaagcgagcaagagagagaacaatggcaaagatgaagatgagattatttgagacctcggaaacaatttcagatcctcatcaagaaactagagagatcaagataaccaatggtgtacaattactagaaaaggaaaataaagaacaagaatggagtaatactaatgatgttcacatggtagagtatcaaatggattctgtgagcatcatagagaagtttcttggactaaccagtgactctagctcctcttccatttttggtgactccgaggaatgttacacaagtcttagttcagtaagaggtacaatttcagcagcaggtaacagcaatgtgttaactaaaaaccctaattgagtaatgcagttttgattaatattagctttttggtaattccaggaatgtcgacaccaaggg

SEQ ID NO: 606 - protein, 317 aa, Arabidopsis thaliana
MFPSFITHIQSPNSHHHYSSPSFPFSSDFLESFDESFLINQFLLQQQDVAANVVESPWKFCKKLELKKKNEKCVDGSTSQEVQWRRTVKKRDRHSKICTAQGPRDRRMRLSLQIARKFFDLQDMLGFDKASKTIEWLFSKSKTSIKQLKERVAASEGGGKDEHLQVDEKEKDETLKLRVSKRRTKTMESSFKTKESRERARKRARERTMAKMKMRLFETSETISDPHQETREIKITNGVQLLEKENKEQEWSNTNDVHMVEYQMDSVSIIEKFLGLTSDSSSSSIFGDSEECYTSLSSVRGTISAAGNSNVLTKNPN

SEQ ID NO: 607 - DNA, 1888 bp, Arabidopsis thaliana
tagccgacctctcttctctcttctgaaaaaaacaccaaaggagctttaaatgctccgttacataatctctatctctttccaagaatatagagaaaggaaaataatatacaagaattaaaagaaggtatatcatcatctctctagctagtgatcaaagcaccgtcatcatcatcatatatcatcagcttgcctcagaggagaagaccaacataagagagatcgaagatcaaaatctatctctcttcatcatcttctgctgttactatcatatcacacgctctctcaaacatcatcctatatatagacttctcttcatcatcatcaaatgcaaggtcatcaccagaatcatcatcaacacttatcatcatcctccgccacgtcttcccatggaaacttcatgaacaaagatgggtatgatattggagagatagacccatcactcttcctctatcttgatggacaaggacatcatgatcctccatcaactgctccttctcctttacatcatcatcacacaactcagaatttggcgatgagacctccaacatcgacgctcaacatctttccatctcagcctatgcacatagagccacctccttcttctacacacaataccgataatacaagattagttccggctgctcaacctagtggttccactcgaccagcttctgacccgtccatggacttgaccaatcattctcagtttcatcaacctcctcaaggttctaaatccatcaagaaggaagggaaccgcaagggtcttgcctcatcggaccatgacatacctaaatcgtcagaccctaaaacattgagaagactagcacaaaacagagaagcagcaagaaaaagcagattacgtaaaaaggcttatgttcagcaactcgagtcatgtaggatcaaactgacccaactagaacaagagattcaacgggccagatcccaaggcgtattctttggagggtctcttataggaggagatcaacagcaaggtggactacccattggccctggcaacatcagctctgaagcagcggtgttcgatatggaatatgcgaggtggctggaggagcagcagaggctattaaacgaactaagggtggcaacacaagaacacttgtccgagaacgagcttaggatgtttgtggacacatgtttagctcattatgaccatttgattaacctcaaggctatggtcgctaagaccgatgtcttccacctcatttctggagcatggaaaactccagctgaacgttgcttcttgtggatgggtggtttccgtccatcggagatcattaaggtgattgtgaaccagatagaaccattgacggagcaacagatagttgggatatgtgggctgcaacagtccacacaagaggccgaggaggctctctcgcaaggcctcgaggcgttgaatcaatcactttccgatagcattgtctctgactccctcccgcctgcctccgcaccacttcctcctcatctatccaatttcatgtcacacatgtccttagctctcaacaagctctctgctctcgagggcttcgttctccaggcggataatttgaggcaccaaacgatccataggctgaaccaattgttgacgacccgtcaagaagcacggtgtcttctagccgttgcggagtacttccaccgtcttcaagctctaagttctctctggctagcccgtcctcggcaagatggataatactaaaacaactgatgaaggaaaccaaaaacaaaaacaagagaataggttgattagttagccgccagcttgacctctttatcatatatatcgtctctctactcaaatacagtgcaattagggaaaattgtttggcttctttttggtatatgattcttactattatgtttttaatcaaga

SEQ ID NO: 608 - protein, 460 aa, Arabidopsis thaliana
MQGHHQNHHQHLSSSSATSSHGNFMNKDGYDIGEIDPSLFLYLDGQGHHDPPSTAPSPLHHHHTTQNLAMRPPTSTLNIFPSQPMHIEPPPSSTHNTDNTRLVPAAQPSGSTRPASDPSMDLTNHSQFHQPPQGSKSIKKEGNRKGLASSDHDIPKSSDPKTLRRLAQNREAARKSRLRKKAYVQQLESCRIKLTQLEQEIQRARSQGVFFGGSLIGGDQQQGGLPIGPGNISSEAAVFDMEYARWLEEQQRLLNELRVATQEHLSENELRMFVDTCLAHYDHLINLKAMVAKTDVFHLISGAWKTPAERCFLWMGGFRPSEIIKVIVNQIEPLTEQQIVGICGLQQSTQEAEEALSQGLEALNQSLSDSIVSDSLPPASAPLPPHLSNFMSHMSLALNKLSALEGFVLQADNLRHQTIHRLNQLLTTRQEARCLLAVAEYFHRLQALSSLWLARPRQDG

SEQ ID NO: 609 - DNA, 1913 bp, Arabidopsis thaliana
cgatgatgcaactgggtggtggtactccgaccactacagcggcggctacaaccgtcacaactgctacagcaccaccgccacaatcaaacaacaacgattcagcggcaacagaagcagcggcagcagcggttggggcgtttgaggtgtcggaagagatgcacgaccgtgggtttggaggaaatcgttggccgcggcaggaaacgctagcgttgttgaaaatacgatctgacatgggaatagcgtttcgagacgctagcgttaaaggtcccttatgggaagaggtttctaggaaaatggcggagcatggttacataagaaacgcaaagaaatgcaaagagaaattcgagaacgtttacaaataccacaaacgaaccaaagaaggtcgtaccggaaaatccgaaggcaaaacttatcgcttctttgatcaattagaagctctcgagtctcaatctacaacctcactccaccatcatcaacaacaaacgcctcttcgaccacagcaaaacaacaacaacaacaacaacaacaacaacaacagctccatattttcaactcctcctccggtaacgacagttatgccgacgcttccttcttcatcaattcctccgtatactcagcagattaatgtaccttcgtttccaaacatctccggtgattttctatcggataattctacatcgtcttcgtcttcttattcgacttcttctgacatggagatgggtggtggaactgcgactacaaggaagaaaaggaagaggaaatggaaggtgtttttcgagcggttgatgaaacaagtagttgataaacaggaagagcttcaacgcacattcttggaagctgttgaaaagcgagaacacaagagattggttagagaagagtcttggagagttcaagagattgccagaatcaaccgcgagcacgagatcttagctcaagaacgctctatgtccgctgcaaaagacgctgctgttatggcctttcttcaaaaactgtcagagaaacaaccgaatcagccacaaccgcagcctcagccgcaacaagttcgaccatcaatgcagcttaataacaacaatcagcagcaaccgcctcaacggtctcctccaccgcaacctcctgctccgcttccgcagccaattcaagcggttgtgtcgacgttagacacaacgaaaacgcacaatcgtggtgatcagaatatgactcctgcagcttcagcgagctcgtcgcggtggccgaaagtggagatagaagcattgataaagctgaggacgaatcttgattcgaaatatcaagaaaacggaccaaaaggaccattgtgggaagagatatcagcgggaatgagaaggttaggattcaacaggaactcaaagagatgcaaagagaaatgggaaaacataaacaaatacttcaagaaagtcaaagagagcaacaagaaacgtcccgaagattccaagacttgcccttactttcaccagcttgatgctttatatagagagaggaacaaattccacagcaacaacaacattgcagcttcttcttcatcttccggtcttgttaaaccggataattctgttcccttgatggtccaaccagagcagcaatggcctccggctgtaacgactgcgacaactactcccgcagcggctcagcctgatcagcaatctcagccgtcggagcagaactttgatgatgaagaaggtacagatgaagagtacgacgatgaagatgaggaagaggagaatgaagaagaggaaggaggtgagttcgagcttgtgcctagcaataacaacaacaacaagacgacgaataatctgtaatgatgatgattcgagttcgaaccggtttggtggtgaaagattagtaatctttttttaagttttgatacagaacatgagaatttaaatattggagggttt

SEQ ID NO: 610 - protein, 602 aa, Arabidopsis thaliana
MQLGGGTPTTTAAATTVTTATAPPPQSNNNDSAATEAAAAAVGAFEVSEEMHDRGFGGNRWPRQETLALLKIRSDMGIAFRDASVKGPLWEEVSRKMAEHGYIRNAKKCKEKFENVYKYHKRTKEGRTGKSEGKTYRFFDQLEALESQSTTSLHHHQQQTPLRPQQNNNNNNNNNNNSSIFSTPPPVTTVMPTLPSSSIPPYTQQINVPSFPNISGDFLSDNSTSSSSSYSTSSDMEMGGGTATTRKKRKRKWKVFFERLMKQVVDKQEELQRTFLEAVEKREHKRLVREESWRVQEIARINREHEILAQERSMSAAKDAAVMAFLQKLSEKQPNQPQPQPQPQQVRPSMQLNNNNQQQPPQRSPPPQPPAPLPQPIQAVVSTLDTTKTHNRGDQNMTPAASASSSRWPKVEIEALIKLRTNLDSKYQENGPKGPLWEEISAGMRRLGFNRNSKRCKEKWENINKYFKKVKESNKKRPEDSKTCPYFHQLDALYRERNKFHSNNNIAASSSSSGLVKPDNSVPLMVQPEQQWPPAVTTATTTPAAAQPDQQSQPSEQNFDDEEGTDEEYDDEDEEEENEEEEGGEFELVPSNNNNNKTTNNL

SEQ ID NO: 611 - DNA, 2044 bp, Arabidopsis thaliana
caaaaaaaatctctcccattaaaagactgcccaaagaaatattttatacaaaatgaaagagagaaacacgacacgaattttgtataattaagattacacaaaaaaaagtgttagaaagagaaatatcttcttcttttttctgtgtgagttgggtttgttaaagttttatcctttttgttctcaaaatcaagaatcgatggcggagaaggaagaaaaagaaccatcgaagttaaaatcatccaccggagtttcacggccaacgatttcactacctcctcgaccgtttggtgaaatgttttttagcggtggcgttggatttagtcctggaccaatgactctcgtctcaaatttattctctgatcctgatgagttcaagtctttctctcagcttttagctggagctatggcttctccggcggcagctgctgttgccgccgctgctgtggttgctactgctcatcatcagacacctgtgagctctgtcggtgatggcggtggaagcggtggtgatgttgacccgaggtttaagcagagtagaccaacgggattgatgataactcaaccaccggggatgtttactgtaccgccggggttaagtccggctactcttttggattctccgagcttctttggtcttttttcacctcttcagggaacatttggtatgacacatcaacaagctttagcacaagtcactgcacaagcagttcaaggcaataatgttcatatgcagcaatcacaacaatctgaatatccttcttctacacaacaacaacaacaacaacaacaacaagcttcattgactgagattccatcattttcttctgcacctaggtctcagattcgagcctcggttcaagaaacatcgcagggtcagagagagacttcggaaatatctgtctttgagcatcggtcacagcctcaaaatgctgacaaaccagctgatgatggatacaactggcggaaatatgggcagaagcaagtgaaggggagcgattttcctcggagttattacaaatgtacgcatccagcttgtcctgtcaagaagaaagtggagaggtcactcgatggacaagtaacggaaatcatctacaagggtcaacacaatcatgagcttcctcaaaagcgcggtaacaataacgggagttgtaaaagttctgatattgcaaatcagtttcaaacaagtaatagcagtctcaacaagagtaagagggaccaggaaacaagccaagttacaacaacagagcagatgtctgaagcaagtgatagcgaggaggttgggaatgcagagactagtgtgggagaaagacatgaggatgagcctgatcccaagcgaagaaatacagaagttcgggtttcagaaccagttgcttcatcgcatagaactgtgacagagcctaggattattgtccaaacgacgagtgaagttgacctcttagatgatggatataggtggcgcaagtatggtcagaaagtagtcaaaggaaatccttatccgaggagctactataagtgtacaacaccagattgcggagtaaggaaacatgtagagagagcagcaactgacccaaaagctgttgtaacaacatatgaaggtaaacataaccatgatgttccagctgctagaaccagcagccatcagttaagaccaaacaatcaacacaacacctcaacggttaacttcaatcatcaacagcctgttgcacgtttaaggcttaaagaagagcaaatcacttgacagagaagaagaatacgacggcgcttgagcttttgtgagtttaatgaatcttctttttggttaatgaacctgtttttgttgcctcaaaacaccacaggtttctctggacagaatctctgatattacagtttcaaaaggtatgttcttttatttcatgttggaatcttctgtgtaatcttaagaagctttaggaggtaatgtaaaaaaccagattcaaagttatgcccttatgtgaattcttttgtacatgggataaacaaaatttacaggtatcctttttgttcttgttgtaaaaaaaaaaaaaaa

SEQ ID NO: 612 - protein, 513 aa, Arabidopsis thaliana
MAEKEEKEPSKLKSSTGVSRPTISLPPRPFGEMFFSGGVGFSPGPMTLVSNLFSDPDEFKSFSQLLAGAMASPAAAAVAAAAVVATAHHQTPVSSVGDGGGSGGDVDPRFKQSRPTGLMITQPPGMFTVPPGLSPATLLDSPSFFGLFSPLQGTFGMTHQQALAQVTAQAVQGNNVHMQQSQQSEYPSSTQQQQQQQQQASLTEIPSFSSAPRSQIRASVQETSQGQRETSEISVFEHRSQPQNADKPADDGYNWRKYGQKQVKGSDFPRSYYKCTHPACPVKKKVERSLDGQVTEIIYKGQHNHELPQKRGNNNGSCKSSDIANQFQTSNSSLNKSKRDQETSQVTTTEQMSEASDSEEVGNAETSVGERHEDEPDPKRRNTEVRVSEPVASSHRTVTEPRIIVQTTSEVDLLDDGYRWRKYGQKVVKGNPYPRSYYKCTTPDCGVRKHVERAATDPKAVVTTYEGKHNHDVPAARTSSHQLRPNNQHNTSTVNFNHQQPVARLRLKEEQIT

SEQ ID NO: 613 - DNA, 1064 bp, Arabidopsis thaliana
taaagaaagagaaaaaaagctttcgtagtgtctattgaaaccagagaaaagccaaaggggatgcaaccaacatccgtcggtagtagcggcggtggtgacgacggaggaggcagaggaggaggaggagggctaagtagaagtggactatctcggatccgttcagctccagcgacttggcttgaagctttacttgaggaagatgaagaagagtctttgaaacctaatcttggtctcaccgatttgcttaccgggaactcgaacgatttaccgacaagtcgcggctcgttcgagttcccgattcctgttgagcaagggttgtatcaacaaggtgggtttcaccgacagaatagtactccggcggattttcttagtggttctgatggatttatccaaagctttgggattcaggcgaattacgattacttatcggggaatatcgatgtttctccgggaagtaagcggtctagagaaatggaagcactcttctcttctcctgagtttacttctcaaatgaaaggagagcaaagcagcggtcaagttcctaccggagtatcaagcatgtcggatatgaacatggagaaccttatggaggactctgttgcttttagggttcgggctaaacgtggttgcgcaactcatccccgcagcattgccgagagggtacgaaggacgcggattagtgatcggataaggaagctacaagagcttgtacctaacatggacaagcaaaccaacactgcagacatgttagaagaagcagtagaatacgtgaaagttcttcaaaggcagatccaggagttaacagaagaacagaagaggtgcacatgcatacctaaggaagaacaataaggtttgctcctgatttgttttatatttgcttaacggcaatgatctgatcgaaaaattcgaaagatgatcttagcttgaatttagatggatgtcatgttgaaaagtatattatttgataaatggatgtaggtgtaatataaaatttttgtacaataatgaagaaagttaaaaagaattaatgaaaacatatattctttatgatataaaaaaaaaaa

SEQ ID NO: 614 - protein, 262 aa, Arabidopsis thaliana
MQPTSVGSSGGGDDGGGRGGGGGLSRSGLSRIRSAPATWLEALLEEDEEESLKPNLGLTDLLTGNSNDLPTSRGSFEFPIPVEQGLYQQGGFHRQNSTPADFLSGSDGFIQSFGIQANYDYLSGNIDVSPGSKRSREMEALFSSPEFTSQMKGEQSSGQVPTGVSSMSDMNMENLMEDSVAFRVRAKRGCATHPRSIAERVRRTRISDRIRKLQELVPNMDKQTNTADMLEEAVEYVKVLQRQIQELTEEQKRCTCIPKEEQ

SEQ ID NO: 615 - DNA, 1354 bp, Arabidopsis thaliana
gcctttttgactcttctttctctcttctactttttttcaggctctctctctatatctctatcttcttctccggttaactaaaagagaaatgaaaagccgagtgagaaaatccaagtacacggttcaccggaaaatcacatccacaccgttcgacggtttcccgaagattgtcaaaatcatagtcactgacccatgcgctactgattcttccagcgatgaggaaaacgacaacaaatctgttgctccgagggtgaaacgttatgtggatgagatcaggttctgtgacgaagatgacgaacctaaaccggcgaggaaagcgaagaaaaagtccccggcggctgcggcggagaacggtggagatttggtaaagtctgtggtgaagtatagaggagtgagacaacgaccttggggaaaatttgcggcggagattcgtgatccttcgagtcgtactagactctggcttgggacttttgcgacggcggaggaagctgctataggttacgatagagccgcgattcgaatcaaaggtcataacgctcagacgaattttctcactcctcctcctagtccgacgactgaggtgttaccggaaactccggtgattgaccttgaaactgtctctggttgtgattcggcgagggaatcgcaaatcagtctgtgttctccgacttctgttctccggtttagtcacaacgacgaaacagagtacagaacagagccaacggaagaacaaaatccgtttttcttgcctgatttgtttcgctccggagattatttttgggattccgaaattacccctgaccctttgtttctcgacgaattccaccagtccttgttaccaaacatcaacaacaacaacacagtgtgtgataaggatacgaatctgtctgatagttttccgttgggagtgatcggagatttcagctcatgggatgttgatgagtttttccaagatcatttgttggataagtaatttgatgagttcttccccagaatttttctgggtttctctttttggttgtgtgagtgagatgagtggtttgatgacaacgacggggatgaatcttagccgtccgttttccatttcgtggacggctccgatcagcggaagaagcgcaacggagtttttatttatctgtttgagaattttataatttaatttgcgagtaaatatagtaattagtgttaagattgtgagagtttaagttaattagggaggggttttgaatattggggattttgggaggtttttgtttggtttctctccaagtctgtcactatgcaaggaagcagtataaagaccgtatatatattttattattaatattgataaaagtaaaaaaaaaaaaaaaaa

SEQ ID NO: 616 - protein, 294 aa, Arabidopsis thaliana
MKSRVRKSKYTVHRKITSTPFDGFPKIVKIIVTDPCATDSSSDEENDNKSVAPRVKRYVDEIRFCDEDDEPKPARKAKKKSPAAAAENGGDLVKSVVKYRGVRQRPWGKFAAEIRDPSSRTRLWLGTFATAEEAAIGYDRAAIRIKGHNAQTNFLTPPPSPTTEVLPETPVIDLETVSGCDSARESQISLCSPTSVLRFSHNDETEYRTEPTEEQNPFFLPDLFRSGDYFWDSEITPDPLFLDEFHQSLLPNINNNNTVCDKDTNLSDSFPLGVIGDFSSWDVDEFFQDHLLDK

SEQ ID NO: 617 - DNA, 813 bp, Arabidopsis thaliana
ctgttcacaagaaagctccccaaaaggagcgttgctttactctcctataaaaagaagctcttctacttcttctcgttaccacaaaactctttcaccgatcttctcgttccattcttcttcctaattacaccatgcccaacatcaccatgggtttgaaacccgacccggttgctccaacgaacccgactcatcatgagagtaatgctgccaaagagattcgttacagaggcgttaggaaacgtccatggggaagatacgccgctgagatccgagatccggttaagaaaactcgagtctggctcggtacgttcgacaccgctcagcaggcggcgcgtgcttacgacgcagccgcgcgtgactttcgtggtgttaaggctaagaccaatttcggtgttatcgttggtagtagtcctactcagagtagcaccgtcgtcgactctcccacggcggcacggtttataacacctccgcacctcgagctcagcttaggcggcggcggcgcgtgtcgtcgtaagatcccgcttgtgcatccggtttactactataacatggcgacgtatccaaagatgacgacgtgtggtgtccagagcgagtctgaaacgtcgtcggtcgttgatttcgaaggtggagctgggaagatatctccgccgttagatctggatcttaacttagctcctccggcggaataggccgtgagttttttttttcttatgtcgtttctttagacaaaaaaaaataacgtttcctttttttttctgcctaagaaaaaaatattatccgttttttagaagaaaaaaaaaaaaaaaaaaaaaa

SEQ ID NO: 618 - protein, 185 aa, Arabidopsis thaliana
MPNITMGLKPDPVAPTNPTHHESNAAKEIRYRGVRKRPWGRYAAEIRDPVKKTRVWLGTFDTAQQAARAYDAAARDFRGVKAKTNFGVIVGSSPTQSSTVVDSPTAARFITPPHLELSLGGGGACRRKIPLVHPVYYYNMATYPKMTTCGVQSESETSSVVDFEGGAGKISPPLDLDLNLAPPAE

SEQ ID NO: 619 - DNA, 1693 bp, Arabidopsis thaliana
tcgtcttcttaatcgctttctgctctgtttttctcgttcatcaagctacatctactagctctctcagtgattgatttctcacagtttcatcgatttccatgcgtttaagacctaaaaggacttgttctggggtaaaggacttttcttgttcttgagagagttcattttgaggcttttctgggaattttgagaggttttttagggtttaagggggtttggttttgaatttcgcacaccaagtgttcgataaaatggctgaacgaaagaaacgctcttctattcaaaccaataaacccaacaaaaaacccatgaagaagaaaccttttcagctaaatcacctcccaggtttatctgaagatttgaagactatgagaaaactccgtttcgttgtgaatgatccttacgctactgactactcatcaagcgaagaagaagaaaggagtcagagaaggaaacgttatgtctgtgagatcgatcttcctttcgctcaagctgctactcaagcagaatctgaaagctcatattgtcaggagagtaacaataatggtgtaagcaagactaaaatctcagcttgtagcaaaaaggttttacgcagcaaagcatctccggtcgttggacgttcttctactactgtctcgaagcctgttggtgttaggcagaggaaatggggtaaatgggctgctgagattagacatccaatcaccaaagtaagaacttggttgggtacttacgagacgcttgaacaagcagctgatgcttatgctaccaagaagcttgagtttgatgctctggctgcagccacttctgctgcttcctctgttttgtcaaatgagtctggttctatgatctcagcctcagggtcaagcattgatcttgacaagaagctagttgattcgactcttgatcaacaagctggtgaatcgaagaaagcgagttttgatttcgactttgcagatctacagattcctgaaatgggttgcttcattgatgactcattcatcccaaatgcttgtgagcttgattttctcttaacagaagagaacaacaaccaaatgttggatgattactgtggcatagatgatctggacatcattggtcttgaatgtgacggtccaagcgaacttccagactatgatttctcagatgtggagatcgatcttggtctcattggaaccaccattgacaagtatgctttcgttgatcatatcgcaacaactactcccactcctcttaatatcgcgtgcccataagttttgcagctaggtgttattattagctataggagcaacgtaaaaagctcgttgttactcggttttgtcttaagttattaaagtatagcagaggcagttaatctcaagggaagcaaaaaccctaaagatagaagcagatgcagttttgtgtgttggtgttactaaagaaagttttgttgacataatggttttgatgttgtggagaagatagagaggtgtgatcgaaattgtaaatctcaggtggttttttttgaaggcaattgtttctcatttagggtttttttctatatgaggattgtctttgaaaagcctttagatgttttctaattcgtaagctctctcaatctttgtaagttttgcctgttgagttattgatacatatgtgagacctactttatttgttttgtgctacatacattgttgatggtttcgtcaaaaaaaaa

SEQ ID NO: 620 - protein, 332 aa, Arabidopsis thaliana
MAERKKRSSIQTNKPNKKPMKKKPFQLNHLPGLSEDLKTMRKLRFVVNDPYATDYSSSEEEERSQRRKRYVCEIDLPFAQAATQAESESSYCQESNNNGVSKTKISACSKKVLRSKASPVVGRSSTTVSKPVGVRQRKWGKWAAEIRHPITKVRTWLGTYETLEQAADAYATKKLEFDALAAATSAASSVLSNESGSMISASGSSIDLDKKLVDSTLDQQAGESKKASFDFDFADLQIPEMGCFIDDSFIPNACELDFLLTEENNNQMLDDYCGIDDLDIIGLECDGPSELPDYDFSDVEIDLGLIGTTIDKYAFVDHIATTTPTPLNIACP

SEQ ID NO: 621 - DNA, 549 bp, Arabidopsis thaliana
gaaactcttacatactcatataaaccaaactaaaaccatgattccggcagaaatcaacggatatttccaatatctatcaccggaatacaacgtaataaacatgccttcatctccaacctcttccttaaactacctaaacgatttgatcatcaacaacaacaactattcctcatcatccaacagtcaagatctcatgataagcaacaactcaacttccgacgaagatcatcatcaaagcatcatggtactcgacgagaggaaacagagaaggatgctttcgaacagagaatctgcaaggaggtcaaggatgaggaaacagagacatcttgatgaactctggtctcaggtaataaggcttcgcaacgagaacaactgtcttatcgataagctgaaccgcgtatcggagactcaaaattgtgtattgaaggagaactctaaactcaaagaagaagcttctgatctccgacagcttgtttgtgaactgaaatctaacaagaacaacaacaatagttttccaagagagtttgaagataattagtattactcaaa

SEQ ID NO: 622 - protein, 166 aa, Arabidopsis thaliana
MIPAEINGYFQYLSPEYNVINMPSSPTSSLNYLNDLIINNNNYSSSSNSQDLMISNNSTSDEDHHQSIMVLDERKQRRMLSNRESARRSRMRKQRHLDELWSQVIRLRNENNCLIDKLNRVSETQNCVLKENSKLKEEASDLRQLVCELKSNKNNNNSFPREFEDN

SEQ ID NO: 623 - DNA, 1311 bp, Arabidopsis thaliana
tacttcagacttctactcaaaccagtcacgtagttggttggtgacatttcgctgcatttttcaatctgtgattgtttttcgttcgtctttcttttactattttctcgaaaaggacacaagaagtattgcattcactcagttgagcaacttaacaatcgtgttgtactttttgaagttcccttgagctaaactgctaagagcatgcctctggataagaggcaacgggatttgcctctgggcttaagtcctcaagcttgcttcaaggatatagtaggtcggtctgtccttcctagaattcctctccctgagcttgggaaactatatgcagctaagcttcaggctcgctgtttgcagccaccaccattccagtctttgctgtgcagtcatgataaggagtcttatggaaaaagattctcacggtctgacatgcggtcttggtgcgctgctgctactactactactactccacttggagcattagagtcttctcagaaaagacttttgatattcgatcagtcaggagaccagactcgtctattacaatgtccatttcctctacggtttccatctcatgcggctgcagaaccagtgaaactctctgagttacaaggtatagagaaagctttcaaagaagatggtgaagagtttcacaagagtgatggaacagagtcagaaatgcatgaagacactgaggagatcaatgcattgctatattcagatgatgattatgatgatgattgcgagagtgatgatgaagtaatgagcactggtcactctccttatccaaatgaaggagtttgcaacaaaagggaattagaagaaatcgatggtccttgtaaaaggcagaaactactggataaggtcaacaacatcagcgacttatcatcacttgtgggcactgagagctccacacaactcaatggatcttcctttcttaaggacaaaaagctccctgaatcaaaaaccatatcgaccaaagaggacactggttctggtctgagcaacgagcagtcgaagaaagacaagatccgcacagctctgaaaatactcgagagcgtagtccctggtgcaaaaggaaacgaagcgctcttacttctggacgaagcaattgattacctaaagttgctgaaacgagacttaatctccacagaggttaagaaccaaagctccaccactcacaagtcaccaatcttgttgcttaaagagacaacatggggaacaagaaatctgcagacagataaggcgtgaaagattctgacgagttaaaacgtgtgaagtgggtttttgggtacgtatccttgcaccagcttt

SEQ ID NO: 624 - protein, 348 aa, Arabidopsis thaliana
MPLDKRQRDLPLGLSPQACFKDIVGRSVLPRIPLPELGKLYAAKLQARCLQPPPFQSLLCSHDKESYGKRFSRSDMRSWCAAATTTTTPLGALESSQKRLLIFDQSGDQTRLLQCPFPLRFPSHAAAEPVKLSELQGIEKAFKEDGEEFHKSDGTESEMHEDTEEINALLYSDDDYDDDCESDDEVMSTGHSPYPNEGVCNKRELEEIDGPCKRQKLLDKVNNISDLSSLVGTESSTQLNGSSFLKDKKLPESKTISTKEDTGSGLSNEQSKKDKIRTALKILESVVPGAKGNEALLLLDEAIDYLKLLKRDLISTEVKNQSSTTHKSPILLLKETTWGTRNLQTDKA

SEQ ID NO: 625 - DNA, 1239 bp, Arabidopsis thaliana
ctcgatcttttaacccccattattacatattactccttcctacattattcttcttctgctttcgtgactttcaggggacacttttgtttttataacttacgcttaaaatcctatgaattcgccgccggttgacgcaatgattaccggagaatcatcgtcacaaagatctatcccaacgccgtttctcacaaaaacgtttaacctcgttgaagatagttccatcgacgatgttatctcatggaacgaagatggttcctctttcatcgtatggaatccgacagatttcgctaaagatttgcttcctaaacacttcaaacacaacaatttctctagtttcgttcgtcagctcaacacttacggattcaaaaaagttgtaccggatcgatgggagttttcaaacgatttctttaagagaggagaaaaacgtcttctccgtgagatccaacgtcggaaaataacaacgacgcatcaaacagttgttgctccttcgtcggaacaacgaaaccagacgatggttgtatcaccgtcaaattccggggaagataataataataatcaggtgatgtcttcgtctccgtcgtcgtggtattgtcatcaaacgaagacgactgggaatggtggtttatcagtggagttattggaagagaacgagaagcttcggagtcaaaacattcagctaaaccgtgagcttactcagatgaaatctatctgcgataatatctatagtctcatgtcgaattacgtcggatctcagcccactgatcggagttattctcccggaggtagtagtagtcaaccgatggagtttttaccggcgaagcggttttcggagatggagattgaagaagaagaagaagcgagtccgaggttgtttggtgttccgattgggttaaaacggacgagaagtgaaggtgttcaggtgaagacgacggcggtggttggggaaaattccgatgaggagacgccgtggttgagacattataatcgaaccaatcagagagtttgtaattaaaaacgaacggtttagatttgtggtgtagatatgtgcgcgaagtagacgattacagctttttaagacaagcagagcacgtgtcccatctgtttcaagaagtttctgcaatcttgacttcttcttttaacactttgtgttttttattatttaattaataacaataaatgttctttttcagttttgttttcttcaaaaatagttcggctgtttctagactttcctttttt

SEQ ID NO: 626 - protein, 299 aa, Arabidopsis thaliana
MNSPPVDAMITGESSSQRSIPTPFLTKTFNLVEDSSIDDVISWNEDGSSFIVWNPTDFAKDLLPKHFKHNNFSSFVRQLNTYGFKKVVPDRWEFSNDFFKRGEKRLLREIQRRKITTTHQTVVAPSSEQRNQTMVVSPSNSGEDNNNNQVMSSSPSSWYCHQTKTTGNGGLSVELLEENEKLRSQNIQLNRELTQMKSICDNIYSLMSNYVGSQPTDRSYSPGGSSSQPMEFLPAKRFSEMEIEEEEEASPRLFGVPIGLKRTRSEGVQVKTTAVVGENSDEETPWLRHYNRTNQRVCN

SEQ ID NO: 627 - DNA, 1196 bp, Arabidopsis thaliana
gcatttataattactcactcatcttcttttcattacattacataccaaacaagagctctcaaatggaaaggtttcaaggacacatcaacccctgtttcttcgatcgaaaaccggatgtgagaagcctcgaggttcaaggatttgcagaggctcaaagctttgctttcaaagaaaaagaggaagaaagcttacaagatacagttccatttctacagatgctgcaaagtgaagacccctcatcgtttttttcaatcaaagagccaaactttctgacgctactgtctcttcaaaccctcaaggagccttgggaactcgaaagatatctttcacttgaggattcacaatttcattcaccggtccaatctgagaccaaccgcttcatggaaggagccaatcaagctgtgtcaagccaagaaattccctttagccaagcaaacatgacactcccttcttctacctcatcaccactcagtgcacattcaagacgaaagcgcaaaatcaaccacttgctgcctcaagaaatgactagagaaaagagaaagaggaggaaaacaaaaccaagtaaaaacaatgaagagattgagaatcaaagaataaaccacattgctgttgaacgaaacagaagacgtcaaatgaacgaacatatcaactctctccgggcccttctcccaccttcctacatccaacgaggagaccaagcttccatagtaggaggagcaataaactacgtgaaggtcctcgagcaaatcatacaatctctcgaatcgcaaaagagaacgcaacaacaaagtaacagtgaggtagtagaaaacgcacttaatcatctctcaggcatttcgtcgaacgacctgtggacaactcttgaagatcaaacttgtatccccaaaatcgaagctacagtgatacaaaaccatgtcagccttaaagttcaatgtgagaagaaacaaggacaacttctcaaaggaatcatatcacttgaaaagcttaaactcactgttcttcatctcaatatcactacttcgtctcattcctctgtttcttattccttcaacctcaagatggaagatgagtgcgacttagagtcagccgacgagattacggcggctgttcatcggattttcgatattccgacaatttgattaaacacatataattccaaaaatattaacagctgacaaaatggtatctttgcggcc

SEQ ID NO: 628 - protein, 358 aa, Arabidopsis thaliana
MERFQGHINPCFFDRKPDVRSLEVQGFAEAQSFAFKEKEEESLQDTVPFLQMLQSEDPSSFFSIKEPNFLTLLSLQTLKEPWELERYLSLEDSQFHSPVQSETNRFMEGANQAVSSQEIPFSQANMTLPSSTSSPLSAHSRRKRKINHLLPQEMTREKRKRRKTKPSKNNEEIENQRINHIAVERNRRRQMNEHINSLRALLPPSYIQRGDQASIVGGAINYVKVLEQIIQSLESQKRTQQQSNSEVVENALNHLSGISSNDLWTTLEDQTCIPKIEATVIQNHVSLKVQCEKKQGQLLKGIISLEKLKLTVLHLNITTSSHSSVSYSFNLKMEDECDLESADEITAAVHRIFDIPTI

SEQ ID NO: 629 - DNA, 911 bp, Arabidopsis thaliana
attctaaagtcctcctctcggaaagtaagagactcaacttccgagccgccatggacgccggagtagcagtaaaagctgacgtggcagtcaaaatgaagagagaaagaccattcaaagggatcagaatgagaaaatgggggaaatgggttgcggagattcgagaacccaacaagcgttcaagactttggctcggctcttactctactcccgaagcggcggcgcgtgcatacgacacggctgtcttttacctcagaggaccaactgctacgctcaacttcccggagcttctgccgtgtacctccgccgaggatatgtcagcggcaacgatcaggaaaaaggcgacggaggtgggagctcaagtagatgcgataggggcgacggtggtgcagaacaacaaacgccgccgcgtttttagtcaaaagcgtgactttggcggcgggttattagagcttgttgacttgaacaagttacctgacccggaaaatctcgatgatgatttggtgggaaaatagactgaaaaataataataaaatatcttacaatggtggctgtagctatcgtacgcggaatgcttgggcttgtgttatatgactacgtggttacggaaagattcctctgtttcgtcattgtattaaaatttaatcccacaagtcaaacatactgtacattattcttaatttagtattttcttattaatatctatcatttgtttggtgaacaccagaatattagactattaatgtaacgagtttttaatatttcgatcataataacaccaagctagttaaaggttaatatcttgttacgaagtcttgagtaagttcaattgtcatatatatgtaacggaagaggttcgttcgggtcccaagtgaagtggatcaaaggtgacttcacataaaaaataaaaaaaa

SEQ ID NO: 630 - protein, 153 aa, Arabidopsis thaliana
MDAGVAVKADVAVKMKRERPFKGIRMRKWGKWVAEIREPNKRSRLWLGSYSTPEAAARAYDTAVFYLRGPTATLNFPELLPCTSAEDMSAATIRKKATEVGAQVDAIGATVVQNNKRRRVFSQKRDFGGGLLELVDLNKLPDPENLDDDLVGK

SEQ ID NO: 631 - DNA, 912 bp, Arabidopsis thaliana
cgtcgacctcttaattaagacgacttgagagagaaagaaagatacgtggaagatgaccaaatctggagagagaccaaaacagagacagaggaaagggttatggtcacctgaagaagaccagaagctcaagagtttcatcctctctcgtggccatgcttgctggaccactgttcccatcctagctggattgcaaaggaatgggaaaagctgcagattaaggtggattaattacctaagaccaggactaaagagggggtcgtttagtgaagaagaagaagagaccatcttgactttacattcttccttgggtaacaagtggtctcggattgcaaaatatttaccgggaagaacagacaacgagattaagaactattggcattcctatctgaagaagagatggctcaaatctcaaccacaactcaaaagccaaatatcagacctcacagaatctccttcttcactactttcttgcgggaaaagaaatctggaaaccgaaaccctagatcacgtgatctccttccagaaattttcagagaatccaacttcatcaccatccaaagaaagcaacaacaacatgatcatgaacaacagtaataacttgcctaaactgttcttctctgagtggatcagttcttcaaatccacacatcgattactcctctgcttttacagattccaagcacattaatgaaactcaagatcaaatcaatgaagaggaagtgatgatgatcaataacaacaactactcttcacttgaggatgtcatgctccgtacagattttttgcagcctgatcatgaatatgcaaattattattcttctggagatttcttcatcaacagtgaccaaaattatgtctaagaagagtgaatatgatcgtaagaggaacataagctagttacttgtgttacagc

SEQ ID NO: 632 - protein, 268 aa, Arabidopsis thaliana
MTKSGERPKQRQRKGLWSPEEDQKLKSFILSRGHACWTTVPILAGLQRNGKSCRLRWINYLRPGLKRGSFSEEEEETILTLHSSLGNKWSRIAKYLPGRTDNEIKNYWHSYLKKRWLKSQPQLKSQISDLTESPSSLLSCGKRNLETETLDHVISFQKFSENPTSSPSKESNNNMIMNNSNNLPKLFFSEWISSSNPHIDYSSAFTDSKHINETQDQINEEEVMMINNNNYSSLEDVMLRTDFLQPDHEYANYYSSGDFFINSDQNYV

SEQ ID NO: 633 - DNA, 990 bp, Arabidopsis thaliana
atgggaagagctccgtgttgcgacaagacaaaagtgaagcgagggccttggtcgcctgaagaagactctaaacttagagattacattgaaaagtatggtaatggtggaaattggatctctttccccctcaaagccggtttgaggagatgtgggaagagttgtagactgaggtggctaaactatttgagaccaaacataaagcatggtgacttctctgaggaagaagacaggatcatttttagtctcttcgctgccataggaagcaggtggtcaataatagcagctcatctaccgggacgaacagacaacgacataaaaaactattggaacacaaagctaaggaagaaactcttgtcttcttcctctgattcatcatcatcagccatggcttctccttatctaaaccctatttctcaggatgtgaaaagaccaacctcaccaacaacaatcccatcttcttcttacaatccgtatgctgaaaaccctaatcaatacccaacaaaatccctcatctccagcatcaatggcttcgaagctggtgacaaacagataatttcctatattaaccctaattatcctcaagatctctatctctcggacagcaacaacaacacctcgaacgcaaatggtttcttgctcaaccacaatatgtgtgatcagtacaagaaccacaccagtttttcttcagacgtcaatgggataagatcagagattatgatgaagcaagaagagataatgatgatgatgatgatagaccaccacattgaccagaggacaaaagggtacaatggggaattcacacaagggtattataattactacaatgggcatggggatttgaagcaaatgattagtggaacaggcactaattctaacataaacatgggtggttcaggttcatcttctagttcgataagcaacctagctgagaacaaaagcagtggtagcctcctactagaatacaaatgcttgccctatttctactcctag

SEQ ID NO: 634 - protein, 329 aa, Arabidopsis thaliana
MGRAPCCDKTKVKRGPWSPEEDSKLRDYIEKYGNGGNWISFPLKAGLRRCGKSCRLRWLNYLRPNIKHGDFSEEEDRIIFSLFAAIGSRWSIIAAHLPGRTDNDIKNYWNTKLRKKLLSSSSDSSSSAMASPYLNPISQDVKRPTSPTTIPSSSYNPYAENPNQYPTKSLISSINGFEAGDKQIISYINPNYPQDLYLSDSNNNTSNANGFLLNHNMCDQYKNHTSFSSDVNGIRSEIMMKQEEIMMMMMIDHHIDQRTKGYNGEFTQGYYNYYNGHGDLKQMISGTGTNSNINMGGSGSSSSSISNLAENKSSGSLLLEYKCLPYFYS

SEQ ID NO: 635 - DNA, 849 bp, Arabidopsis thaliana
atgggaagatcaccttgttgtgataaaaatggagtgaagaagggaccatggactgctgaggaggatcagaaactcatcgattatattcgatttcatggtcctggcaattggcgtacgctccccaaaaatgctggactccatagatgtggaaaaagctgccgtcttcgatggaccaattatctaagaccggacatcaagagaggaagattctcgttcgaggaagaagaaactatcattcagctacacagtgttatgggaaacaagtggtcagcaatagccgctcgtctaccagggaggaccgataacgaaataaaaaaccattggaacactcacatccgcaagagacttgtaaggagtggtatcgaccctgttactcattctccacgccttgatcttcttgatttgtcctcacttttgagtgcacttttcaaccagccaaacttttcagcagttgcaacacatgcgtcttctcttcttaatcctgatgtattgaggttggcctctctactactgccacttcaaaaccctaatccagtttacccatcgaacctcgaccaaaatcttcaaactccaaatacatcatcagaatcgtctcaaccacaagctgagactagtacagtcccaacaaactatgaaacttcatcattggagcctatgaacgcaagactcgacgacgttggtcttgcagatgtattaccacctttgtcagagagttttgacttagactcgctcatgtcaacgccaatgtcttctccacgacaaaatagcattgaagcagaaaccaactccagcactttcttcgactttggaattccggaagatttcatcttagatgactttatgttttaa

SEQ ID NO: 636 - protein, 282 aa, Arabidopsis thaliana
MGRSPCCDKNGVKKGPWTAEEDQKLIDYIRFHGPGNWRTLPKNAGLHRCGKSCRLRWTNYLRPDIKRGRFSFEEEETIIQLHSVMGNKWSAIAARLPGRTDNEIKNHWNTHIRKRLVRSGIDPVTHSPRLDLLDLSSLLSALFNQPNFSAVATHASSLLNPDVLRLASLLLPLQNPNPVYPSNLDQNLQTPNTSSESSQPQAETSTVPTNYETSSLEPMNARLDDVGLADVLPPLSESFDLDSLMSTPMSSPRQNSIEAETNSSTFFDFGIPEDFILDDFMF

SEQ ID NO: 637 - DNA, 1088 bp, Arabidopsis thaliana
aagagggaatctcaaaagtgtgtgtctgtgagagaggagagagagaatatgggcaaaggaagagcaccatgttgtgacaaaaccaaagtgaagagaggaccatggagccatgatgaagacttgaaactcatctctttcattcacaagaatggtcatgagaattggagatctctcccaaagcaagctggattgttgaggtgtggcaagagttgtcgtctgcgatggattaattacctcagacctgatgtgaaacgtggcaatttcagtgcagaggaagaagacaccatcatcaaacttcaccagagctttggtaacaagtggtcgaagattgcttctaagctgcctggaagaacagacaatgagatcaagaatgtgtggcatacacatctcaagaaaagattgagctcggaaactaaccttaatgccgatgaagcgggttcaaaaggttctttgaatgaagaagagaactctcaagagtcatctccaaatgcttcaatgtcttttgctggttccaacatttcaagcaaagacgatgatgcacagataagtcaaatgtttgagcacattctaacttatagcgagtttacggggatgttacaagaggtagacaaaccagagctgctggagatgccttttgatttagatcctgacatttggagtttcatagatggttcagactcattccaacaaccagagaacagagctcttcaagagtctgaagaagatgaagttgataaatggtttaagcacctggaaagcgaactcgggttagaagaaaacgataaccaacaacaacaacagcataaacagggaacagaagatgaacattcatcatcactcttggagagttacgagctcctcatacattaatgaagccataaagcaagtcattttcaccttgaaaatggaattattagctaacttattggcattattagtatataagcaagatcagataggcgcatgtagtagcaacaacgaagaaacgtcgaattgtagacaaaatgtagatattacagagttgaaagattgtattttgcaaatgattgctttgtagtgaaatcaagttatcacaaaaaaaaaaaaaa

SEQ ID NO: 638 - protein, 273 aa, Arabidopsis thaliana
MGKGRAPCCDKTKVKRGPWSHDEDLKLISFIHKNGHENWRSLPKQAGLLRCGKSCRLRWINYLRPDVKRGNFSAEEEDTIIKLHQSFGNKWSKIASKLPGRTDNEIKNVWHTHLKKRLSSETNLNADEAGSKGSLNEEENSQESSPNASMSFAGSNISSKDDDAQISQMFEHILTYSEFTGMLQEVDKPELLEMPFDLDPDIWSFIDGSDSFQQPENRALQESEEDEVDKWFKHLESELGLEENDNQQQQQHKQGTEDEHSSSLLESYELLIH

SEQ ID NO: 639 - DNA, 606 bp, Arabidopsis thaliana
atggaatgcaaaagagaagaagggaagtcttacgtgaagagagggttgtggaaaccagaagaagatatgatattaaaaagctatgttgagactcatggtgaaggaaactgggcagacatttctcgtagatccgggttgaagagaggaggaaaaagctgtaggctgagatggaagaactatctaagaccaaatatcaaaagaggaagcatgtcaccacaagaacaagaccttatcatccgcatgcataagcttcttggaaacagatggtcgttgatcgctggtcgccttccaggtcgtactgacaatgaagtgaagaactactggaatactcatttgaacaagaaacctaattcccgaaaacagaatgcacctgaatcaatcgtcggcgccactcctttcacggataagccagttatgtctacagaactgagaagaagccatggagaaggaggagaagaggagagcaatacctggatggaggagaccaaccactttggctatgacgtccacgtaggatctcccttgccacttatttcccactacccagacaacactctcgtgtttgacccatgtttttcctttaccgatttctttcctctgctttag

SEQ ID NO: 640 - protein, 201 aa, Arabidopsis thaliana
MECKREEGKSYVKRGLWKPEEDMILKSYVETHGEGNWADISRRSGLKRGGKSCRLRWKNYLRPNIKRGSMSPQEQDLIIRMHKLLGNRWSLIAGRLPGRTDNEVKNYWNTHLNKKPNSRKQNAPESIVGATPFTDKPVMSTELRRSHGEGGEEESNTWMEETNHFGYDVHVGSPLPLISHYPDNTLVFDPCFSFTDFFPLL

SEQ ID NO: 641 - DNA, 1274 bp, Arabidopsis thaliana
atagctcccaactaataggaatctcaagcttctcactctctcttgtttttccattggacttttggaacataagctatgcaaactgaggagcttttgtcgccaccacagactccttggtggaatgcttttggatctcagccgttgactacagagagcctttccggcgaagcttctgattcattcaccggagttaaggcagttactacggaggcagaacaaggtgtggtggataaacaaacttctacaactctcttcactttctcacctggtggtgaaaagagttcaagagatgtgccaaagcctcatgttgctttcgcgatgcaatcagcttgcttcgagtttggatttgctcagccaatgatgtacacaaagcatcctcatgttgaacaatactatggagttgtttcagcatacggatctcagaggtcttcgggccgagtaatgattccactgaagatggagacagaagaagatggtaccatctatgtgaactcaaagcagtaccatggaattatcaggcgacgccagtcccgagcaaaggctgaaaaactgagtagatgccgtaagccatatatgcatcactcacgccatctccatgctatgcgccgtcctagaggatctggcgggcgtttcttgaacaccaagacagctgatgcggctaagcagtctaagccgagtaattctcagagttctgaagtctttcatccggaaaatgagaccataaactcatcgagggaagcaaatgagtcaaatctctcggattctgcagttacaagtatggattactttctaagttcgtcggcttattctcctggtggcatggtcatgcctatcaagtggaatgcagcagcaatggatattggctgctgcaaacttaatatatgatcagcagataggggacaagacatgattggtcaccagtccttttgtcttgtcccttatctttcagccaaacggaaagagaacttgtgtcttggaaaaaagacattgagtttccttggtttataagattggtccttttaccatccgtttggctgtaaacaggcaaatcatctttggctcatgcttcatcaagttcttatcttcgtctgttttcttctacgcatcttcataagatctctgaactagtgaataacatttcctagcatcatgtttcaactagtgtgtgttgtaagaaactctgccttatttccagatgatgtattgtgtgtaacgtgtttatgaaacaaacgtaagactttcaagttaaaaaaaaaaaaaaaaaaaaaaaaaaa

SEQ ID NO: 642 - protein, 269 aa, Arabidopsis thaliana
MQTEELLSPPQTPWWNAFGSQPLTTESLSGEASDSFTGVKAVTTEAEQGVVDKQTSTTLFTFSPGGEKSSRDVPKPHVAFAMQSACFEFGFAQPMMYTKHPHVEQYYGVVSAYGSQRSSGRVMIPLKMETEEDGTIYVNSKQYHGIIRRRQSRAKAEKLSRCRKPYMHHSRHLHAMRRPRGSGGRFLNTKTADAAKQSKPSNSQSSEVFHPENETINSSREANESNLSDSAVTSMDYFLSSSAYSPGGMVMPIKWNAAAMDIGCCKLNI

SEQ ID NO: 643 - DNA, 1017 bp, Arabidopsis thaliana
cagctttaacactactctctctctctctcaaatgggaaaacaaatcaacatagagagtagtgctactcatcatcaagacaatattgtttccgttataacagccacgatatcctcctcctccgtcgtaacgtcttcgtcagactcttggtctacctccaaaagatcgttagtgcaagacaatgactccggagggaaacggcggaagagcaacgttagtgatgataacaagaatccgacgtcgtatagaggagtgaggatgaggagttggggaaaatgggtgtcggagattagagagccgaggaagaaatcaagaatatggcttggcacttatccaacggcagagatggcagctcgtgctcatgatgtggcggctttagctattaaaggcaactccggttttcttaatttccctgaattatccggtttgcttcctcgtccggttagctgctctcctaaggatatacaagctgcagctaccaaagccgccgaagcaaccacgtggcacaaaccggttatcgataagaaattagctgatgagctaagccactctgagttgttgtctaccgctcagtcttcgacttctagtagtttcgtgttttcttcggacacgtcggagacttctagtacggacaaggaaagcaacgaagagacggtgtttgatttgccggaccttttcacggacgggcttatgaacccaaacgatgcgttttgtttatgcaacggcacctttacgtggcagctttacggagaggaggatgtagggttcaggtttgaagagccgtttaattggcaaaatgactaaaccgccctccacttgcttactgtaattactaacatataattttcttgataaagaacatatatttccattacggtattaactaatcttttctatccttttctcttttcttgtttctacatctgagtatattgtcactatgtgaaaaaattgatctcgttttgaatatttacttttcaaaattgaagtaacgcaagtgattgataaaaaaaaaaaaa

SEQ ID NO: 644 - protein, 256 aa, Arabidopsis thaliana
MGKQINIESSATHHQDNIVSVITATISSSSVVTSSSDSWSTSKRSLVQDNDSGGKRRKSNVSDDNKNPTSYRGVRMRSWGKWVSEIREPRKKSRIWLGTYPTAEMAARAHDVAALAIKGNSGFLNFPELSGLLPRPVSCSPKDIQAAATKAAEATTWHKPVIDKKLADELSHSELLSTAQSSTSSSFVFSSDTSETSSTDKESNEETVFDLPDLFTDGLMNPNDAFCLCNGTFTWQLYGEEDVGFRFEEPFNWQND

SEQ ID NO: 645 - DNA, 2008 bp, Arabidopsis thaliana
ctctcatttcgccatagctgagagcttcttctactttcccttagcttcttttttccttcatttttgttctacccttgcgaatctctgaaatgaaccctcaagctaatgaccggaaggagtttcagggagattgttcggcgacgggagatctcacggcaaagcacgattcagctggaggaaacggaggtggaggtgctaggtataagctgatgtcaccggccaagcttccgatctcgaggtcgactgatatcacgattcctcctgggttgagtccgacttcgtttttggaatctcctgttttcatctccaacatcaagccagaaccttcccctactactggttctttgttcaagcctcgaccagtgcacatttctgctagctcaagttcttatacaggcagggggttccatcagaacacctttactgagcagaagtccagtgaatttgagttcagacctcctgcatcaaatatggtatatgcagagcttggcaagattagaagtgagccaccagtacattttcaaggccagggccatggatcctcacactcaccttcttcgatcagtgatgctgcaggttcctcaagtgagctaagccggccaactcctccttgtcagatgacaccaacgagctcagatattccggctggatctgatcaagaggaatcaatccagacttcccaaaatgactccagaggaagcactccatccatcttggctgatgatggttataactggagaaaatatggtcaaaagcatgtcaaagggagtgaatttccccggagctattataaatgtacacatcctaattgtgaagtgaaaaagttatttgaaagatctcatgatgggcagatcaccgatattatatacaagggtacacatgaccatcctaaacctcaacctggtcgccgaaactctggtggtatggctgcacaagaagaaaggctagacaagtatccttcttcaactggccgagatgagaagggatctggcgtctacaacttgtctaaccccaatgaacaaactggtaaccctgaagtacctcctatctcagcatctgacgatggtggagaagcggcagcgtcaaataggaataaagatgagccggacgatgatgatccattctcaaaacggaggaggatggagggtgcgatggaaataactccactagtgaaacccatccgggagcctcgggttgttgttcaaactctgagtgaggttgacattctggatgatggttatagatggcgcaaatatgggcagaaagtcgtaagggggaacccaaatcccaggagctactacaaatgcacagctcatggatgcccagtgagaaaacacgtggagagagcatcacatgatccaaaagctgtaataacaacatacgaaggcaaacacgatcatgatgttcccacttcaaagtctagcagcaatcacgaaatccagcctcggttcagaccagatgaaacagacaccatcagcctcaatcttggtgttggaatctcatctgatggacctaaccacgcttccaacgaacatcagcaccagaatcaacaacttgtcaaccaaactcacccaaatggagtcaatttcaggtttgttcatgctagtcccatgtcatcctactatgctagcttaaatagcggtatgaatcagtacggccagagagaaacaaagaacgagactcaaaatggtgacatctcgtccttgaacaattcatcttacccatatccgcccaacatggggagagtacaatcgggtccgtaaaacaaaaagtaagcaacattatgtacgggatcttcttaggttaggaatgggacgaggccttgttctatataattcctatttcttcacagagagctgatcttgattcaaactatctccaccatatatatttgtttgtgtcacctgtattgagttccaaaaatgttatgtaaaaatacacaacaagatgttaatgcttttatttaaacaagaaacagcaatattactacaaaaaaaaaaaaaaaaaa

SEQ ID NO: 646 - protein, 557 aa, Arabidopsis thaliana
MNPQANDRKEFQGDCSATGDLTAKHDSAGGNGGGGARYKLMSPAKLPISRSTDITIPPGLSPTSFLESPVFISNIKPEPSPTTGSLFKPRPVHISASSSSYTGRGFHQNTFTEQKSSEFEFRPPASNMVYAELGKIRSEPPVHFQGQGHGSSHSPSSISDAAGSSSELSRPTPPCQMTPTSSDIPAGSDQEESIQTSQNDSRGSTPSILADDGYNWRKYGQKHVKGSEFPRSYYKCTHPNCEVKKLFERSHDGQITDIIYKGTHDHPKPQPGRRNSGGMAAQEERLDKYPSSTGRDEKGSGVYNLSNPNEQTGNPEVPPISASDDGGEAAASNRNKDEPDDDDPFSKRRRMEGAMEITPLVKPIREPRVVVQTLSEVDILDDGYRWRKYGQKVVRGNPNPRSYYKCTAHGCPVRKHVERASHDPKAVITTYEGKHDHDVPTSKSSSNHEIQPRFRPDETDTISLNLGVGISSDGPNHASNEHQHQNQQLVNQTHPNGVNFRFVHASPMSSYYASLNSGMNQYGQRETKNETQNGDISSLNNSSYPYPPNMGRVQSGP

SEQ ID NO: 647 - DNA, 1281 bp, Arabidopsis thaliana
gtgaaacatggggaaggaagttatggtgagcgattacggtgacgacgacggagaagacgccggcggcggcgatgaatataggattccggaatgggaaattggtttacccaacggagatgatttgactccgttatctcaatatctagtcccgtcgattctcgcgttagctttcagcatgatcccagaacgaagccgtacaattcacgacgtcaatcgcgcgtcgcaaatcacgctctcttcgttgagaagcagtaccaatgcttcgtctgtgatggaggaggtcgtggatcgagttgaatcgagtgttccaggatcagatccgaagaaacagaagaaatcggatggtggtgaagcagcggcggtggaggattccacggcggaggaaggagactccgggcctgaagacgcgtctgggaagacatcgaaacgaccgcgtttagtgtggacaccgcagctacacaagagatttgtggacgttgtggctcatctagggattaaaaacgcagtgccgaagacgattatgcagctgatgaacgtggaaggacttactcgtgagaacgttgcgtctcatttgcagaaatataggctttaccttaaacggattcaaggattgacgacggaagaagatccttattcgtcgtcggatcagctcttctcttcaacgccggttcctccacagagctttcaagacggcggaggaagtaacggaaagttgggggttccggttccggttccgtcgatggtgcctattccaggctatgggaatcaaatgggtatgcaaggatattatcaacagtatagtaaccatggcaatgaatcaaaccaatatatgatgcagcagaataagtttggaacaatggtgacatatccttctgttggtggtggtgacgtgaatgacaagtaaatggatcttaaaggtctataatttgctctacagagagatactggttcttggcttatggtttattttcccacttcatgaggttgttgtgacttttaattctccatgttttccacacaagtctttattgcctttgtatagaaaatgatttcgagaaaatcactgggaagcttggtattgttggaggatgaagccttctatgaatgatttagtttcctactgtctccattctttatgaggtaataaagccttcttttgctcatcgcttgtagtcttcttaaattcaagacagcgtcacatgtttgttcggttatgttaattgtttctttctttggataatgaagatagcatcaggtctcatgtctcctcactttgataaa

SEQ ID NO: 648 - protein, 298 aa, Arabidopsis thaliana
MGKEVMVSDYGDDDGEDAGGGDEYRIPEWEIGLPNGDDLTPLSQYLVPSILALAFSMIPERSRTIHDVNRASQITLSSLRSSTNASSVMEEVVDRVESSVPGSDPKKQKKSDGGEAAAVEDSTAEEGDSGPEDASGKTSKRPRLVWTPQLHKRFVDVVAHLGIKNAVPKTIMQLMNVEGLTRENVASHLQKYRLYLKRIQGLTTEEDPYSSSDQLFSSTPVPPQSFQDGGGSNGKLGVPVPVPSMVPIPGYGNQMGMQGYYQQYSNHGNESNQYMMQQNKFGTMVTYPSVGGGDVNDK

SEQ ID NO: 649 - DNA, 783 bp, Arabidopsis thaliana
atggaaaacgaagtaaacgcaggaacagcaagcagttcaagatggaacccaacgaaagatcagatcacgctactggaaaatctttacaaggaaggaatacgaactccgagcgccgatcagattcagcagatcaccggtaggcttcgtgcgtacggccatatcgaaggtaaaaacgtcttttactggttccagaaccataaggctaggcaacgccaaaagcagaaacaggagcgcatggcttacttcaatcgcctcctccacaaaacctcccgtttcttctacccccctccttgctcaaacgtgggttgtgtcagtccgtactatttacagcaagcaagtgatcatcatatgaatcaacatggaagtgtatacacaaacgatcttcttcacagaaacaatgtgatgattccaagtggtggctacgagaaacggacagtcacacaacatcagaaacaactttcagacataagaacaacagcagccacaagaatgccaatttctccgagttcactcagatttgacagatttgccctccgtgataactgttatgccggtgaggacattaacgtcaattccagtggacggaaaacactccctctttttcctcttcagcctttgaatgcaagtaatgctgatggtatgggaagttccagttttgcccttggtagtgattctccggtggattgttctagcgatggagccggccgagagcagccgtttattgatttcttttctggtggttctacttctactcgtttcgatagtaatggtaatgggttgtaa

SEQ ID NO: 650 - protein, 260 aa, Arabidopsis thaliana
MENEVNAGTASSSRWNPTKDQITLLENLYKEGIRTPSADQIQQITGRLRAYGHIEGKNVFYWFQNHKARQRQKQKQERMAYFNRLLHKTSRFFYPPPCSNVGCVSPYYLQQASDHHMNQHGSVYTNDLLHRNNVMIPSGGYEKRTVTQHQKQLSDIRTTAATRMPISPSSLRFDRFALRDNCYAGEDINVNSSGRKTLPLFPLQPLNASNADGMGSSSFALGSDSPVDCSSDGAGREQPFIDFFSGGSTSTRFDSNGNGL

SEQ ID NO: 651 - DNA, 766 bp, Arabidopsis thaliana
catcaccaatcttttgaatctaagagagagaagaagaagaaggtctagagaacgaaaagaagaaacatgaataaccagaatgtagatgatcataatcttctactcatttctcaattgtaccctaatgtctatactccattagtaccacaacaaggaggagaagcaaaaccaacacggcggaggaaaaggaagagcaagagtgttgtggtggcagaggagggtgaaaacgaaggcaatgggtggtttagaaagagaaaattgagtgatgagcaagtaagaatgttggagattagctttgaagacgatcataagcttgaatccgagaggaaagatcggcttgcttctgagttagggcttgatcctcgtcaagtcgccgtctggttccaaaaccgccgtgcacggtggaagaacaaacgagtcgaggatgaatacactaaactcaagaatgcatacgaaaccaccgtcgttgagaaatgtcgtcttgattctgaggttattcacctaaaggaacaactttacgaggctgaaagagagatccaacggcttgcaaaaagagttgaaggaactttaagtaacagtcctatctcatcctctgtgaccattgaagccaatcatacgacaccgttttttggagattacgacatcggatttgacggtgaggctgacgagaacttgctctactcgccagattacattgatggattagactggatgagccaatttatgtaaaaaactataagctaatctattttcagtcgtagtatag

SEQ ID NO: 652 - protein, 220 aa, Arabidopsis thaliana
MNNQNVDDHNLLLISQLYPNVYTPLVPQQGGEAKPTRRRKRKSKSVVVAEEGENEGNGWFRKRKLSDEQVRMLEISFEDDHKLESERKDRLASELGLDPRQVAVWFQNRRARWKNKRVEDEYTKLKNAYETTVVEKCRLDSEVIHLKEQLYEAEREIQRLAKRVEGTLSNSPISSSVTIEANHTTPFFGDYDIGFDGEADENLLYSPDYIDGLDWMSQFM

SEQ ID NO: 653 - DNA, 867 bp, Arabidopsis thaliana
atggaggttatgagaccgtcgacgtcacacgtgtcaggtgggaactggctcatggaggaaactaagagcggcgtcgcagcttctggtgaaggtgccacgtggacggcggcagagaacaaggcattcgagaatgctttggcggtttacgacgacaacactcctgatcggtggcagaaggtggctgcggtgattccggggaagacagtgagtgacgtaattagacagtataacgatttggaagctgatgtcagcagcatcgaggccggtttaatcccggtccccggttacatcacctcgccgcctttcactctagattgggccggcggcggtggcggatgtaacgggtttaaaccgggtcatcaggtttgtaataaacggtcgcaggccggtagatcgccggagctggagcggaagaaaggcgttccttggacggaggaagaacacaagctatttctaatgggtttgaagaaatatgggaaaggagattggagaaacatatctcggaactttgtgataacgcgaacgccaacacaagtagctagccacgcccaaaagtacttcatccggcaactttccggcggcaaggacaagagacgagcaagcattcacgacataaccaccgtaaatctcgaagaggaggcttctttggagaccaataagagctccattgttgttggagatcagcgttcaaggctaaccgcgtttccttggaaccaaacggacaacaatggaacacaggcagacgctttcaatataacgattggaaacgctattagtggcgttcattcatacggccaggttatgattggagggtataacaatgcagattcttgctatgacgcccaaaacacaatgtttcaactatag

SEQ ID NO: 654 - protein, 288 aa, Arabidopsis thaliana
MEVMRPSTSHVSGGNWLMEETKSGVAASGEGATWTAAENKAFENALAVYDDNTPDRWQKVAAVIPGKTVSDVIRQYNDLEADVSSIEAGLIPVPGYITSPPFTLDWAGGGGGCNGFKPGHQVCNKRSQAGRSPELERKKGVPWTEEEHKLFLMGLKKYGKGDWRNISRNFVITRTPTQVASHAQKYFIRQLSGGKDKRRASIHDITTVNLEEEASLETNKSSIVVGDQRSRLTAFPWNQTDNNGTQADAFNITIGNAISGVHSYGQVMIGGYNNADSCYDAQNTMFQL

SEQ ID NO: 655 - DNA, 784 bp, Arabidopsis thaliana
cttcaaaacatctaaaaaatggtgaaaaaaactcttggtcgtagaaaggtagagatagtgaaaatgactaaggaatcaaaccttcaagtcacattttccaagagaaaagctggtctttttaagaaggctagtgaattttgcacattatgtgatgcaaaaattgcgatgatcgtgttttcaccagctggaaaagtattttcttttggtcatccaaatgttgatgttctgcttgaccactttcgagggtgtgttgtaggacacaacaacacaaaccttgatgaaagctacacaaagcttcatgttcaaatgctcaacaaatcctacactgaggtgaaggcggaagtagaaaaagaacaaaagaataagcagtcgcgggctcaaaatgaaagagaaaacgaaaacgctgaggagtggtggagtaagtctccattagaactcaacttaagtcaatcaacctgtatgatacgtgttcttaaagatttgaagaagatagttgatgaaaaagcaattcaattaatccatcaaacaaacccaaacttctatgttggaagttctagcaatgctgctgctccagcaactgttagtggtggtaatatctccacaaaccaggggttctttgatcaaaacggaatgacgactaatcctactcaaacacttctgtttggatttgatattatgaatcgcacaccaggagtttaaataagtctatcctcattatgggtcttggtactataagttcatctctctcgttgttgactttttaagtctccaatagtttgttgtg

SEQ ID NO: 656 - protein, 226 aa, Arabidopsis thaliana
MVKKTLGRRKVEIVKMTKESNLQVTFSKRKAGLFKKASEFCTLCDAKIAMIVFSPAGKVFSFGHPNVDVLLDHFRGCVVGHNNTNLDESYTKLHVQMLNKSYTEVKAEVEKEQKNKQSRAQNERENENAEEWWSKSPLELNLSQSTCMIRVLKDLKKIVDEKAIQLIHQTNPNFYVGSSSNAAAPATVSGGNISTNQGFFDQNGMTTNPTQTLLFGFDIMNRTPGV

SEQ ID NO: 657 - DNA, 1387 bp, Arabidopsis thaliana
agcaagtccaaatctccctctctctctctctatctatctctctatagaagattttttaactaagaagctagcgatcatggccacagcgatgaacgttttctctaccaaatggtcctccgaattggatatagaagaatatagtatcatccaccaattccacatgaactcactcgtcggagatgttccacagtctctctcatctcttgatgataccaccacttgttataaccttgatgcttcttgtaataaaagtttggtagaagaaagaccttcaaagatcctcaagaccactcacatatcaccaaacttacatcctttttcttcttctaatcctcctcctccaaagcaccagccctcttctaggattctttcttttgaaaagacaggtttacatgttatgaatcacaactctccaaacttaatatttagccccaaggacgaagaaattggattaccagagcataagaaagccgagctgataataagagggacaaagagagctcaatccttgactcgaagccaatcaaatgctcaagatcacatactggcagagagaaaacggagagagaagcttactcaaagatttgtagctctttccgcgctaattcctggcctaaagaagatggacaaggcttctgtgttgggagatgcaataaagcatataaagtacctccaagagagtgtgaaagagtatgaggaacaaaagaaggaaaagacaatggaatcagtggttcttgtaaagaagtctagtctggttttagatgaaaatcatcaaccatcatcatcatcttcctcagatggaaatcgcaatagctcgagctcaaatcttccagaaatagaagttagggtttcaggaaaagatgttcttattaagatcctatgcgagaagcaaaagggtaatgtgatcaagattatgggggagattgaaaagcttggtttgtctatcaccaacagcaatgtcttgccctttggacccacttttgacatctctattatcgctcagaagaataacaattttgatatgaaaatcgaggatgttgtgaagaacttgagttttggcttatcaaagctcacttaattggtttcacgttacatacatatacacattcatcatcgatttctccgatcgaagaatccaaaatcagtttttccatgaaagtggttttttagttgttaagtttgttgtatggagattcttaagtcatttaaagatccttgttcttgtgttgttaagtgtgctttaagatgcatatcatcaaatgtttagtaattatttctctccagtttcatttgggacggaatttttttcgcagttgttggatatatatttcctgcgatgtaaagcatttcgttagtttaataaacgtccgatatgtttctttgaaaa

SEQ ID NO: 658 - protein, 333 aa, Arabidopsis thaliana
MATAMNVFSTKWSSELDIEEYSIIHQFHMNSLVGDVPQSLSSLDDTTTCYNLDASCNKSLVEERPSKILKTTHISPNLHPFSSSNPPPPKHQPSSRILSFEKTGLHVMNHNSPNLIFSPKDEEIGLPEHKKAELIIRGTKRAQSLTRSQSNAQDHILAERKRREKLTQRFVALSALIPGLKKMDKASVLGDAIKHIKYLQESVKEYEEQKKEKTMESVVLVKKSSLVLDENHQPSSSSSSDGNRNSSSSNLPEIEVRVSGKDVLIKILCEKQKGNVIKIMGEIEKLGLSITNSNVLPFGPTFDISIIAQKNNNFDMKIEDVVKNLSFGLSKLT

SEQ ID NO: 659 - DNA, 871 bp, Arabidopsis thaliana
tttctaactagtcacattgagagagagagagagagaaagagagactctcagaatctgaagaagaagaagagattgttgtttttgccttttatcatcggtttctttgaatctctggttttaaatcggatttaatggtggagtctctgttcccgagcatcgaaaacacaggtgaatcgtctcgaagaaagaagccgaggatatcagagacggcggaggcggagatagaggcacgacgtgtcaacgaagaaagcttgaagagatggaaaacgaatcgtgtgcaacagatctacgcttgtaagctcgtcgaagctttacgccgagttcgtcagagatcttccaccaccagcaacaacgagaccgataaactcgtctccggcgcggcgagggagatacgtgatacggcggatcgagttctagctgcgtccgctcgtggtacgactcggtggagcagagcgattttagcgagtcgcgtccgagcgaagctgaagaaacatagaaaggcgaaaaagtcaacgggaaattgtaaatcgagaaaaggtctcacggagacgaatcggattaagttaccggcggttgagagaaaactgaagattcttggccgtttggttcctggttgccggaaagtctctgtaccgaatcttttagatgaagcgaccgattacatcgcagcgttagagatgcaggttcgagccatggaggctctcgccgaacttttaaccgcagccgcaccacggacgacgttgaccggaacttaacggcggcagttagtttgtcagttgttaattagcttttcttttacctttttacccctttattttggcttcaagtgttttttttttctcgtcgacgcgattttaatttattaaattca

SEQ ID NO: 660 - protein, 207 aa, Arabidopsis thaliana
MVESLFPSIENTGESSRRKKPRISETAEAEIEARRVNEESLKRWKTNRVQQIYACKLVEALRRVRQRSSTTSNNETDKLVSGAAREIRDTADRVLAASARGTTRWSRAILASRVRAKLKKHRKAKKSTGNCKSRKGLTETNRIKLPAVERKLKILGRLVPGCRKVSVPNLLDEATDYIAALEMQVRAMEALAELLTAAAPRTTLTGT

SEQ ID NO: 661 - DNA, 898 bp, Arabidopsis thaliana
tcccactatccttcgcaagacccttcctctatataaggaagttcatttcatttggagaggacacgctgacaagctgactctagcagatctggtaccgtcgaccctctctatataatcttcttctacacacacacacacacgcaaccatatacgtacatgtgaagtagtgagatcaatatcgttagcaatgaatctaccaccgggatttaggttttttccgaccgatgaagagctcgtcgttcacttcctccaccggaaagcttccctcttgccttgtcaccctgatgtcatccccgaccttgatctttaccattacgatccttgggaccttcccgggaaagctttgggagaagggaggcaatggtacttctatagtagaaagacacaagagagagtgacaagcaatgggtattggggatcaatgggaatggacgagccaatctacacaagctccacacacaagaaagtgggaatcaaaaagtatctaactttctatctcggagattctcagactaattggatcatgcaagaatattccctcccggattcctcttcttcatctagtcgatcttctaagagatcaagccgtgcttctagttctagtcacaaacccgattatagcaagtgggtgatatgcagagtgtatgagcaaaattgcagtgaggaggaagacgatgatgggacagaactctcatgtttggatgaagtgtttttgtctttagatgatcttgacgaagtaagcttaccgtaataaagacagaagcacccaagaagagaaaaaaaaaaaaagggtttagtgggcaattatttctaagcgaccgctctagacaggcctagtaccggatcctctagctagagctttcgttcgtatcatcggtttcgacaacgttcgtcaagt

SEQ ID NO: 662 - protein, 187 aa, Arabidopsis thaliana
MNLPPGFRFFPTDEELVVHFLHRKASLLPCHPDVIPDLDLYHYDPWDLPGKALGEGRQWYFYSRKTQERVTSNGYWGSMGMDEPIYTSSTHKKVGIKKYLTFYLGDSQTNWIMQEYSLPDSSSSSSRSSKRSSRASSSSHKPDYSKWVICRVYEQNCSEEEDDDGTELSCLDEVFLSLDDLDEVSLP

SEQ ID NO: 663 - DNA, 1031 bp, Arabidopsis thaliana
atatgtacttgtacaccaacccaccaaaagagataaaagaggaaacaaaaactcgaaaagagagagatatatgggtgaggtggcttatatggacgaaggagacctagaagcaatagtcagaggctactccggctccggagacgcgttttccggcgaaagttccggtacgttttcaccttcgttttgcctaccgatggagacgtctagtttctacgaaccggagatggagacaagtggcttagatgagctcggtgaactttacaaacccttttaccctttctccacacaaacgatcctcacaagctcggtctctctccctgaagattcaaaacctttccgagatgacaagaaacaacgatcacatggttgtcttttatccaacggatcaagagctgatcatatccgaatttcagaatccaaatcaaagaaaagcaagaagaatcaacagaagagagttgttgagcaagtgaaagaagagaatctgttgtcggacgcatgggcgtggcgtaaatacgggcagaaacccatcaaaggatctccatacccaaggagttattacagatgcagtagctcaaaagggtgtttggcaagaaaacaagtcgaaagaaatcctcaaaacccggagaaattcaccataacatacactaatgagcacaatcatgaactaccaacccggagaaactcattagccggttcgactcgagcaaaaacttcccaacccaaaccaaccttaaccaaaaaatccgaaaaagaagttgtttcttcccctacaagtaatcctatgatcccatccgctgatgaatcttctgttgcggttcaagaaatgagcgttgcggaaacgagtacgcaccaagcggctggagcaatcgagggccgccgcttgagtaacggtttaccatcggatttgatgtccgggagcggaacttttccaagttttaccggtgacttcgatgaactattgaatagccaagagttcttcagtgggtatttatggaattactagagagcattaggtgtatgtatatatatat

SEQ ID NO: 664 - protein, 310 aa, Arabidopsis thaliana
MGEVAYMDEGDLEAIVRGYSGSGDAFSGESSGTFSPSFCLPMETSSFYEPEMETSGLDELGELYKPFYPFSTQTILTSSVSLPEDSKPFRDDKKQRSHGCLLSNGSRADHIRISESKSKKSKKNQQKRVVEQVKEENLLSDAWAWRKYGQKPIKGSPYPRSYYRCSSSKGCLARKQVERNPQNPEKFTITYTNEHNHELPTRRNSLAGSTRAKTSQPKPTLTKKSEKEVVSSPTSNPMIPSADESSVAVQEMSVAETSTHQAAGAIEGRRLSNGLPSDLMSGSGTFPSFTGDFDELLNSQEFFSGYLWNY

SEQ ID NO: 665 - DNA, 1432 bp, Arabidopsis thaliana
  misc_feature (1419)..(1419): n=a,t,c or g
atcaccaatcctataacactctcattctcatcatatcattcttcaatctatataacccattcttaattatactcaacacacattatatttttctgatcatatcattctttcagtccatctatataaccaattcttgatttatacttaaaacacacattatacatctttctcatcatagtttgtatcaatttcctagagtaaactacctaaaggaaaaaaaaaatctattttgggaatcatatactaaaaatggaaggaagagatatgttaagttgggagcaaaagacattgctaagcgagcttatcaatggatttgatgcggccaaaaagcttcaggcacgacttagagaagctccgtcgccgtcgtcatcattttcatcaccggcgacggctgttgctgagactaacgagattctggtgaagcagatagtttcttcctacgagagatctcttcttctgctaaactggtcatcctcaccgagcgtacaacttattccgacgccggttactgtagtcccggtggcaaatcccggcagtgttccagaatctccggcatcgataaacggaagtccgagaagtgaagagtttgccgatggaggaggttctagcgagagtcatcatcgccaagattacattttcaattcaaagaaaagaaagatgttaccaaagtggtcagaaaaagtgagaataagcccagagagaggcttagaaggacctcaagatgatgtctttagctggagaaaatatggtcaaaaagacattttaggcgccaaattcccaaggagttattacagatgcacacatcgtagcacacaaaactgttgggcaacgaaacaagtccagagatcagacggggatgctacggttttcgaagtgacgtacagaggaacacacacttgttcgcaggcgatcacaagaacaccaccattagcctcgccggagaagcgacaagacaccagagtcaaaccagccattacccaaaagccaaaggatattctcgagagtcttaaatccaacttaaccgttcgaaccgatgggcttgatgatggtaaagacgttttctcgttccctgatacgccgccgttttacaattacggaactatcaacggcgagttcggccacgtggagagttctccgatcttcgacgttgttgactggttcaatccaacggtcgagattgacacaactttccccgcgtttttacacgagtcgatttattattaattaaaatttgtaacagagaaatagatagtaactagtaagtaatgatcagcgagagttaaaacataaaagtacttagagtaatctaacgatgcataataaggaatgttcaacaggacttgaacatgatttcaatactaagagagatttatctagctactggtagtagccgcagacttcttgttgtagcttcacttnctttttgttgctt

SEQ ID NO: 666 - protein, 324 aa, Arabidopsis thaliana
MEGRDMLSWEQKTLLSELINGFDAAKKLQARLREAPSPSSSFSSPATAVAETNEILVKQIVSSYERSLLLLNWSSSPSVQLIPTPVTVVPVANPGSVPESPASINGSPRSEEFADGGGSSESHHRQDYIFNSKKRKMLPKWSEKVRISPERGLEGPQDDVFSWRKYGQKDILGAKFPRSYYRCTHRSTQNCWATKQVQRSDGDATVFEVTYRGTHTCSQAITRTPPLASPEKRQDTRVKPAITQKPKDILESLKSNLTVRTDGLDDGKDVFSFPDTPPFYNYGTINGEFGHVESSPIFDVVDWFNPTVEIDTTFPAFLHESIYY

SEQ ID NO: 667 - DNA, 927 bp, Arabidopsis thaliana
atgcaagtgtttcaaaggaaagaagattcatcttggggaaactcaatgcctacaacaaattcaaatattcaaggatctgaatctttcagcttgactaaggatatgataatgtctacaacacaattacccgcgatgaaacattcgggtttgcagctgcaaaatcaagattcaacctcatcacaatctactgaagaagaatcaggcggcggtgaagttgcaagctttggagaatataagcgttatggatgcagcattgttaataacaatctctcaggttacatcgaaaacttgggaaagcctattgaaaattatactaagtcaattactacctcgtcgatggtgtctcaagactctgtgtttcctgctcctacttctggtcaaatatcttggtctcttcaatgtgctgaaacgtcacatttcaatggtttcttggctcctgaatatgcatcaacaccaacggcgctgccacatttagagatgatgggtttggtttcttcaagagtgccattgcctcatcacattcaagagaatgaaccaatatttgtcaatgcgaaacagtatcatgcgattctccgtcgcaggaagcaccgtgctaaactcgaagctcagaacaaactcatcaaatgccgtaaaccgtaccttcatgagtctcgccatcttcatgctttaaagagagctagaggctccggtggacgtttcctcaatacaaagaagcttcaagaatcatcaaactcactgtgttcttctcaaatggcaaatggacaaaatttctctatgagccctcacggtggtggaagcggaatcgggtctagttcgatctcaccgagctccaattcaaactgtatcaacatgttccaaaacccgcagttcagattctcaggttatccgtcaacacaccatgcctcagctctcatgtcagggacttga

SEQ ID NO: 668 - protein, 308 aa, Arabidopsis thaliana
MQVFQRKEDSSWGNSMPTTNSNIQGSESFSLTKDMIMSTTQLPAMKHSGLQLQNQDSTSSQSTEEESGGGEVASFGEYKRYGCSIVNNNLSGYIENLGKPIENYTKSITTSSMVSQDSVFPAPTSGQISWSLQCAETSHFNGFLAPEYASTPTALPHLEMMGLVSSRVPLPHHIQENEPIFVNAKQYHAILRRRKHRAKLEAQNKLIKCRKPYLHESRHLHALKRARGSGGRFLNTKKLQESSNSLCSSQMANGQNFSMSPHGGGSGIGSSSISPSSNSNCINMFQNPQFRFSGYPSTHHASALMSGT

SEQ ID NO: 669 - DNA, 1974 bp, Arabidopsis thaliana
tgaattctagcctttttgtaggcgaatcatctggaccggtaagagactctctcatcgataataaccacataatttaatcaaactctttctctctctttctaagatcttttgctttgctcttttcctttttgatcttcctatatatggagaagcaccaaaacggtacttactatacgatactgtacggatccatcaaactggattaattatcaaaacgtacatttttatcttacctggcaagttacattcctagggttttggagaatccaatcaacaacaaagaaaataatcatcgttacaataatcagtatcacgcacagacttagatgttccggtttccagtgagtctaggcggttcacgtgacgaagaccgtcacgatcagatcacaccgttggatgaccatcgtgtggtggttgatgaggttgacttcttctcagagaagagagatagggtttcacgtgagaacatcaacgacgacgacgacgaaggcaataaggttctcatcaaaatggagggttcacgagttgaagaaaacgatcgttccagagatgtcaatatcggtctgaatcttctgaccgcgaatacgggaagcgatgagtcaacggtggatgatggactatcaatggatatggaagataaacgtgcaaagattgagaacgcacaactacaagaagagctcaagaagatgaaaatagagaatcaaaggctaagagatatgttgagccaagcgacgaccaacttcaatgccttacaaatgcaacttgttgccgtcatgaggcaacaagaacaacgtaactcttcacaagatcatctcctggagagcaaagcagaaggaaggaaacggcaggaactgcaaatcatggtgccaaggcagttcatggaccttgggccgtcgtctggagcagcagagcatggagccgaagtgtcatctgaagagaggacaacggttcgttcaggttctcctccttcgcttctagaaagttccaatccccgagagaacggaaagaggttgcttggaagagaagaaagctcagaggaatcagagtctaacgcctggggaaaccctaacaaagtccccaaacataatccatcctctagcaatagcaatggaaacagaaacggaaatgttattgatcagtcggccgcagaagccaccatgcggaaagcccgtgtctcagttcgtgcccgatctgaagctgccatgataagcgatggatgtcaatggagaaagtacggacaaaaaatggctaaaggaaacccgtgtccgcgggcttattatcgttgcacaatggccggtggatgtccagttcgcaagcaagtgcagcgttgcgcagaagacagatctattctcataaccacctacgaaggaaaccacaaccatccactcccaccagccgctacggccatggcctcaacaaccaccgcagctgcaagcatgctcctctcgggctcaatgtcgagtcaagacggtttaatgaacccaacaaacctcctagctcgagctatcttgccttgctcctcaagcatggctacaatctcagcctccgcaccattcccaaccatcacattggacctcaccaattcacccaacggtaacaaccctaatatgaccactaataacccgttgatgcagttcgctcaacggcccggtttcaacccggcagttttgcctcaagtggttggtcaagctatgtacaataaccaacaacagtccaagttttctggtttacagttaccggctcagccactgcagatcgcggccacttcctcggtggccgagagcgttagtgctgccagtgcagcaattgcgtccgatccaaactttgcggcggctctagcggcagcgatcacgtccattatgaacggttccagtcatcaaaataataacaccaataataataatgtggctacgagcaacaatgacagtaggcaataagagttttcattttgatggtcgatttttttttttgggg

SEQ ID NO: 670 - protein, 536 aa, Arabidopsis thaliana
MFRFPVSLGGSRDEDRHDQITPLDDHRVVVDEVDFFSEKRDRVSRENINDDDDEGNKVLIKMEGSRVEENDRSRDVNIGLNLLTANTGSDESTVDDGLSMDMEDKRAKIENAQLQEELKKMKIENQRLRDMLSQATTNFNALQMQLVAVMRQQEQRNSSQDHLLESKAEGRKRQELQIMVPRQFMDLGPSSGAAEHGAEVSSEERTTVRSGSPPSLLESSNPRENGKRLLGREESSEESESNAWGNPNKVPKHNPSSSNSNGNRNGNVIDQSAAEATMRKARVSVRARSEAAMISDGCQWRKYGQKMAKGNPCPRAYYRCTMAGGCPVRKQVQRCAEDRSILITTYEGNHNHPLPPAATAMASTTTAAASMLLSGSMSSQDGLMNPTNLLARAILPCSSSMATISASAPFPTITLDLTNSPNGNNPNMTTNNPLMQFAQRPGFNPAVLPQVVGQAMYNNQQQSKFSGLQLPAQPLQIAATSSVAESVSAASAAIASDPNFAAALAAAITSIMNGSSHQNNNTNNNNVATSNNDSRQ

SEQ ID NO: 671 - DNA, 1226 bp, Arabidopsis thaliana
aagacataattttctctgttttcctagctctctcctctcaaattcttccattgctctctgttttggcaaatcgtgaactgccacgtctttaaggcatcagtgaagcaaagatggactttgacgaggagctaaatctttgtattacgaaaggtaaaaatgttgatcattcttttggaggagaagcttcttccacgtccccaagatctatgaagaaaatgaagagtcctagtcgtcctaaaccctatttccaatcctcttcttctccttattcgttagaggctttccctttttctctcgatccaacacttcagaatcagcaacaacaactcggatcatacgttccggtacttgagcaacgacaagacccgacaatgcaaggccagaagcaaatgatctcctttagtcctcaacaacaacaacagcagcagcagtatatggcccagtactggagtgacacattgaatctgagtccaagaggaagaatgatgatgatgatgagccaagaagctgttcaaccttacatcgcaacgaagctgtacagaggagtgagacaacgtcaatggggaaaatgggtcgcagagatccgtaagccacgaagcagggcacgtctttggcttggtacctttgatacagctgaagaagctgccatggcctacgaccgccaagccttcaaattacgaggccacagcgcaacactgaatttcccggagcattttgtgaataaggaaagcgagctgcatgattcaaactcgtcggatcagaaagaacctgaaacgccacagccaagcgaggttaacttggagagcaaggaactaccggtgattgatgttgggagagaggaaggtatggctgaggcatggtacaatgccattacatcgggatggggtcctgaaagtcctctttgggatgatttggatagttctcatcagttttcatcagaaagctcatcttcttctcctctctcttgtcctatgaggcctttcttttgaaaaagtttataaacccacattgtgttgtaggttatagtttagggttatgctcattggcatttggatggaggcaatttttgtgatctcccattccaccacatatcagtcattatatgtgtctaccttttctctgtatttctatcattatcattgtttttattatgtgtctgtatgtgtttccctattgctacatacatagatgtcctctttgttcaaaaaaaaaaaaaaaaaaaaaaa

SEQ ID NO: 672 - protein, 292 aa, Arabidopsis thaliana
MDFDEELNLCITKGKNVDHSFGGEASSTSPRSMKKMKSPSRPKPYFQSSSSPYSLEAFPFSLDPTLQNQQQQLGSYVPVLEQRQDPTMQGQKQMISFSPQQQQQQQQYMAQYWSDTLNLSPRGRMMMMMSQEAVQPYIATKLYRGVRQRQWGKWVAEIRKPRSRARLWLGTFDTAEEAAMAYDRQAFKLRGHSATLNFPEHFVNKESELHDSNSSDQKEPETPQPSEVNLESKELPVIDVGREEGMAEAWYNAITSGWGPESPLWDDLDSSHQFSSESSSSSPLSCPMRPFF

SEQ ID NO: 673 - DNA, 1107 bp, Arabidopsis thaliana
aaatgcccttagaggctgtcgtatacccgcaagatccattcggatatctctccaattgcaaagattttatgttccacgacttatactctcaagaagagttcgtagctcaagatacgaagaacaacattgataagttagggcatgaacagagctttgtggaacaaggtaaggaggacgatcatcaatggcgagactatcatcagtatcctttgttgatcccttcgttgggagaagagcttggtcttaccgccattgatgtggagagtcatcctcctccacagcaccggaggaagaggaggagaacgagaaactgcaagaacaaggaagagatcgagaaccagagaatgactcacatcgccgtcgagagaaatcgccggaaacagatgaacgagtatctggctgtgctccgttctctaatgccgtcgtcgtatgctcaaagaggagatcaagcgtcgatagtaggaggagctataaactacgtgaaggagttagagcatattttacaatctatggagccgaagagaactaggactcatgatcccaaaggagacaagactagcactagctcgttagtgggtccattcacagattttttcagcttcccacaatattctacaaagtcatcatcagatgtaccggaaagctcatcttcaccggcggagatagaggttacggtggcagaaagccatgcgaacatcaagataatgacgaagaagaaaccgaggcagcttcttaagctcataacttctttacaaagcctaaggctcactcttcttcatctcaatgtcaccactctccacaactccattctctactccatcagcgtcagggttgaagaaggaagccaactgaataccgtggacgacattgcaacagctttgaatcaaaccataaggaggattcaagaagagacataattcagcaaatagattataattaacttgttttatttttattttattttgaaataactgaaatcagttttctaattttttttttttttcactattcctctaatcctccctatgtaagttgcatttttgtctcttgtaatgaatcaatggtcataaagatctgaacaaaaaaattgaataaaagaaaatggtt

SEQ ID NO: 674 - protein, 304 aa, Arabidopsis thaliana
MPLEAVVYPQDPFGYLSNCKDFMFHDLYSQEEFVAQDTKNNIDKLGHEQSFVEQGKEDDHQWRDYHQYPLLIPSLGEELGLTAIDVESHPPPQHRRKRRRTRNCKNKEEIENQRMTHIAVERNRRKQMNEYLAVLRSLMPSSYAQRGDQASIVGGAINYVKELEHILQSMEPKRTRTHDPKGDKTSTSSLVGPFTDFFSFPQYSTKSSSDVPESSSSPAEIEVTVAESHANIKIMTKKKPRQLLKLITSLQSLRLTLLHLNVTTLHNSILYSISVRVEEGSQLNTVDDIATALNQTIRRIQEET

SEQ ID NO: 675 - DNA, 729 bp, Arabidopsis thaliana
atgaagatttggtgtgctgtttgtgataaagaagaagcttcggtgttttgttgtgcggatgaagcagctctttgtaatggttgcgatcgccatgttcatttcgccaataaactagccgggaaacatctccggttctctctcacttctcctactttcaaagatgctcctctttgtgatatttgcggggagaggcgtgcattattattttgccaagaagacagagcaatactatgcagagaatgtgacattccaatacatcaagctaatgagcacactaagaaacacaatagattcctccttaccggcgttaagatctctgcctccccgtcagcctacccaagagcctccaattccaactctgctgctgcatttggtcgagccaaaacccgaccaaaatcagtatcgagcgaggtcccgagctcggcctccaatgaggtatttacgagctcttcttcgacgaccacgagcaattgctattatgggatagaagaaaactaccatcacgtgagcgattcggggtcgggatcgggttgtacaggtagtatatccgagtatttgatggagacattaccgggttggagagtggaggatttgcttgaacacccttcttgtgtctcctatgaggataacattattactaataacaataacagtgagtcttatagggtttatgatggttcttcacaattccatcatcaagggttttgggatcacaaacccttctcttga

SEQ ID NO: 676 - protein, 242 aa, Arabidopsis thaliana
MKIWCAVCDKEEASVFCCADEAALCNGCDRHVHFANKLAGKHLRFSLTSPTFKDAPLCDICGERRALLFCQEDRAILCRECDIPIHQANEHTKKHNRFLLTGVKISASPSAYPRASNSNSAAAFGRAKTRPKSVSSEVPSSASNEVFTSSSSTTTSNCYYGIEENYHHVSDSGSGSGCTGSISEYLMETLPGWRVEDLLEHPSCVSYEDNIITNNNNSESYRVYDGSSQFHHQGFWDHKPFS

SEQ ID NO: 677 - DNA, 1115 bp, Arabidopsis thaliana
ccacaactctctccttgtagagagagagattttatggcggtggagctcatgactcggaattacatctccggcgtcggagctgatagcttcgccgttcaagaagcagctgcttcaggactcaaaagtatcgaaaatttcatcggtttaatgtctcgtgatagctttaactctgatcagccatcttcttcttccgcctccgcctccgcctccgccgccgcagatcttgaatcagctcgtaacacaacggcggacgcggctgtttcaaagtttaaaagagtcatatctctcttagatcgaactcgaaccggacacgcccggtttagacgtgctccggttcatgttatttctccggttcttttacaagaagaaccaaaaacgacgccgtttcagtctcctcttcctcctccgccgcaaatgatccgaaaaggttcgttttcttcatcgatgaaaacgattgatttctcatctctctcctctgtaacaacggaatcagacaaccagaagaagattcatcatcatcaacgtccctctgaaacggcgccgtttgcgtctcaaactcaaagcctctccacgacggtctcgtctttctcaaaatcaacaaagagaaaatgtaactctgagaatcttctcaccggaaaatgcgcttccgcttcttcctccggtcgttgtcattgctcgaagaaaagaaagataaaacagaggagaataattagggttccggcgataagtgcaaaaatgtccgatgtaccaccggacgattattcatggaggaaatacggacaaaaaccaattaaaggatctccacatccaagaggatattataagtgtagtagcgtaagaggttgtccagcacgtaaacatgttgagagagcagctgatgattcgtccatgttgattgttacttatgaaggagatcataatcattctctctccgccgctgatctcgccggagccgccgttgctgatcttattttggaatcgtcttgaaaagaacaaatctttatttaaggcttttataatataaatttagatccttacttagtgaagtactcaaactatgaatgaaatcaatgtaatcaaaatcaaaaagcttttgctaaaaaaaaaaaaaaaaa

SEQ ID NO: 678 - protein, 317 aa, Arabidopsis thaliana
MAVELMTRNYISGVGADSFAVQEAAASGLKSIENFIGLMSRDSFNSDQPSSSSASASASAAADLESARNTTADAAVSKFKRVISLLDRTRTGHARFRRAPVHVISPVLLQEEPKTTPFQSPLPPPPQMIRKGSFSSSMKTIDFSSLSSVTTESDNQKKIHHHQRPSETAPFASQTQSLSTTVSSFSKSTKRKCNSENLLTGKCASASSSGRCHCSKKRKIKQRRIIRVPAISAKMSDVPPDDYSWRKYGQKPIKGSPHPRGYYKCSSVRGCPARKHVERAADDSSMLIVTYEGDHNHSLSAADLAGAAVADLILESS

SEQ ID NO: 679 - DNA, 1172 bp, Arabidopsis thaliana
aatcattagcttcttctcttctcttctctcacagagagagtaatcacaagccaagtgagaaaaagaaaacactaaacccagatcgaaaaccatgtctattaacaacaacaacaacaacaacaacaataacaacgatggtcttatgatctcatcaaacggagctttaatcgaacaacaaccatcagtcgttgtgaagaaaccaccggcgaaagatcgacatagcaaagtcgatggaagagggagaagaatccgtatgccgattatatgtgctgctcgtgtttttcagctaacgagagagcttggtcataagtcagatggccaaacaattgaatggttacttcgtcaagcagagccttctattatagctgcaacaggaactggtacaactccagcgagtttctcaactgcttctgtctctatccgtggagccaccaattctacttctttagatcataaacccacttctttacttggtggtacgtcaccgtttatacttgggaaacgtgttagagctgatgaggatagtaataatagtcataatcatagttctgttggtaaagatgagacctttacgacaacaccagctgggttttgggctgttccggcgaggccggattttggacaagtttggagttttgctggagctccacaagagatgtttttacaacaacaacatcatcatcagcaaccattgtttgttcatcagcaacagcaacaacaagctgcaatgggtgaagcttctgctgctagagttgggaattatcttccgggtcatcttaatttgcttgcttctttatccggtggatctcccgggtcggatcgaagagaggaagatccacgttaatggtttaagcccttttaggtttgagggcaaaatttggtatatatatttattatcttctcttctctattgttgtcattgtttctctatgtgtgtgttttagtgttgttagagattgatttggtttcagaatctctgcaagtgatttgagagttttcgttagctttaagtaagttaaagacggttgtttttgattagggttaaattagggtttaagaatctgttgtttttttggagggagatcgatttcttatcggatccaagattacttttaggaaaaaagggaaaatttcagaaaccacggtggtttcttttcctctttttttttttg

SEQ ID NO: 680 - protein, 250 aa, Arabidopsis thaliana
MSINNNNNNNNNNNDGLMISSNGALIEQQPSVVVKKPPAKDRHSKVDGRGRRIRMPIICAARVFQLTRELGHKSDGQTIEWLLRQAEPSIIAATGTGTTPASFSTASVSIRGATNSTSLDHKPTSLLGGTSPFILGKRVRADEDSNNSHNHSSVGKDETFTTTPAGFWAVPARPDFGQVWSFAGAPQEMFLQQQHHHQQPLFVHQQQQQQAAMGEASAARVGNYLPGHLNLLASLSGGSPGSDRREEDPR

SEQ ID NO: 681 - DNA, 1418 bp, Arabidopsis thaliana
tctttcttctctctctatctctcctctttgaaccctaaaaactctttctttacaaggattgatctttttgtatttttgattttgacatttgctttgtgttcgatctctgttttgatgcgatttctctgtttttaaagccatttgatagattgtttccggtaaagctcagcgagagaagaagaagaacaacaatggagtttacagatttctcaaagacgagtttttactacccgtcgtcacaaagcgtttgggatttcggagatttagcggcggcggagaggcattctttagggttcatggagttattaagttctcagcagcatcaagactttgctactgtttctcctcattccttccttctccaaacgtctcaaccgcaaacgcaaacgcaaccatcggcgaagctgtcttcaagtatcattcaagctccaccgtcagagcaattagtgacgtcaaaggtggagtctttgtgttcggatcatttgttgataaacccaccggcgactcctaactcgtcatcgatttcgtctgcttcaagcgaggctctaaatgaagagaaaccgaaaacagaagacaatgaagaagaaggaggtgaagatcaacaagagaagagtcatactaagaaacagttgaaagcaaagaagaataatcagaagagacagagagaggcaagagtcgcattcatgacaaagagtgaagttgatcatctcgaagatggttatcgctggcgaaaatatggtcaaaaagctgtcaaaaacagtccttttcccaggagttactaccgttgcacaacggcttcatgtaacgtgaagaagagagtggagagatcattcagagatccaagcactgtggttacaacctacgaaggtcaacacactcacattagtccactcacgtctcgtcctatttccactggaggtttcttcggatcgtcaggagctgcttcgagtctcggtaatggttgctttgggtttcctattgatggctccacgttaatctctcctcagttccaacagcttgtccaataccatcaccaacagcagcaacaagaactcatgtcttgttttggaggagtcaacgagtaccttaatagccacgctaatgagtatggtgatgataatcgtgtgaagaagagtcgagttttggttaaagataatggacttctgcaagatgttgttccgtctcatatgttgaaggaagagtagtagtatatatatagtcttatagttttaatctagtttttttttgtataattgtctaaaagaaacggatcttttgttctgatgaagaagatgttttcttatggttctgaaatcgtaaggtaatgatgattgtaccaagccgagaaagtacttgtgattttcaccattgaatcactataaatgtaatttttatttactgtgaaaaaaaaaaaaaaa

SEQ ID NO: 682 - protein, 337 aa, Arabidopsis thaliana
MEFTDFSKTSFYYPSSQSVWDFGDLAAAERHSLGFMELLSSQQHQDFATVSPHSFLLQTSQPQTQTQPSAKLSSSIIQAPPSEQLVTSKVESLCSDHLLINPPATPNSSSISSASSEALNEEKPKTEDNEEEGGEDQQEKSHTKKQLKAKKNNQKRQREARVAFMTKSEVDHLEDGYRWRKYGQKAVKNSPFPRSYYRCTTASCNVKKRVERSFRDPSTVVTTYEGQHTHISPLTSRPISTGGFFGSSGAASSLGNGCFGFPIDGSTLISPQFQQLVQYHHQQQQQELMSCFGGVNEYLNSHANEYGDDNRVKKSRVLVKDNGLLQDVVPSHMLKEE

SEQ ID NO: 683 - DNA, 2245 bp, Arabidopsis thaliana
acatttgtttctaatctcagacataaataatttttgttcccgacttcaaaaccaacgatgattatatcattccacattcattttcttctacttcttccttctccttgatctcatttccctagaaaatccatctatcatgggtgaagatgatatagtggagctcttatggaagagtggccaagtcgttagaaccagtcaaacacagagaccctcctccaatacaccaccatctcttcctccaccacccattcttcgtggtagcggaagcggcaacggagaagaaaatgccccgcttccacttccacagccttcacctcccctccatcatcagaatcttttcattctggaagacgaaatgtcttcttggcttcaccattctcaccccggcgttacgtccaccccggcttcttctgtctccctgccaccaccacccaatgctccgcgtgaagatgatatagtggagcttttatggcaaagcggccaagtagttggaaccaaccaaacacatagacaatcctacgatcctcctcccattctccgcggcagcggaagtggcagaggagaagaaaatgctcccctttcacaacctccgcctcacctgcatcagcaaaatctcttcattcaagaaggcgaaatgtattcgtggctacaccattcttaccgccaaaactatttctgctcagaacttctcaactccactccggctactcacccgcaaagttccatctctctggcaccacgtcagactatcgccacgagaagggcggaaaactttatgaacttctcgtggctaagagggaacatatttaccggcggtagagttgatgaagctggaccgtcgttttcggtggtaagagaatcgatgcaggtaggctcgaacacgacccccccttcttcttctgccactgaatcatgtgtaataccagctacagagggcaccgcgagtcgagtgtcgggaactttggcagctcatgatcttggtcggaagggaaaggcggtggcggttgaggcggccggaacaccatcttcaggagtgtgcaaggccgaaacagagccggttcagatacaaccagcaacggagtcgaagctaaaagcgagagaagaaacccatggaactgaagaagctcgtggttcaacgtctagaaagagatcacgaactgcagaaatgcataacctcgccgaaaggagaaggagagaaaagatcaacgagaagatgaagactctgcaacaactcattcctcgctgcaacaaggttgaatctgattctgtttctactctgatcagtctactaaagtttcaacgctggatgatgctatcgagtacgtcaaatcgttacagagccaaatacaagtatgctcttcaaaacagaatgtgttttaaaccaatggttcaacatggaaagagttcatatgtatctagttttgttgagatgatgtcgacgggacagggtatgatgtcgccaatgatgaatgccgggaatacgcaacagttcatgccccatatggccatggatatgaaccgacctcctccattcatacctttccccggcacatcttttcctatgccggctcaaatggcaggtgtaggtccatcatatccagcaccgcgctacccttttcccaacattcagacctttgacccatccagagtccgtttaccaagcccgcagcctaacccggtgtcgaaccagcctcagtttccggcttacatgaatccctatagccagtttgctggtccccaccagttgcaacaacctcctcctcctccatttcagggtcaaacaacatcacaactgagttccgggcaggcaagtagtagcaaggaacctgaggatcaggagaaccaaccaacagcttagttaaagtgtggagctgaaacggatcagttcttcaagcaaattacaactttgaagataaaccagagttgtaacatgtagattttgtctgttaagtttaatgtaagtactttttagttaatgggaaagatactgacaggttgcaaggtggtcagtatttgtgcatcacgcttaagattcctcgatgtggccagtatctcccttttctagcatgtgaggtccctactctctggttctacggagaccaaatgttcgactgattaaacacacaatgacttaccaaaagtacacgcggcccatcctcgtctttatgttccaagtgcgactgtttgtttatttgtaagcatttttcttataataataaaacagctctatcttcgttaaaaaaaa

SEQ ID NO: 684 - protein, 573 aa, Arabidopsis thaliana
MGEDDIVELLWKSGQVVRTSQTQRPSSNTPPSLPPPPILRGSGSGNGEENAPLPLPQPSPPLHHQNLFILEDEMSSWLHHSHPGVTSTPASSVSLPPPPNAPREDDIVELLWQSGQVVGTNQTHRQSYDPPPILRGSGSGRGEENAPLSQPPPHLHQQNLFIQEGEMYSWLHHSYRQNYFCSELLNSTPATHPQSSISLAPRQTIATRRAENFMNFSWLRGNIFTGGRVDEAGPSFSVVRESMQVGSNTTPPSSSATESCVIPATEGTASRVSGTLAAHDLGRKGKAVAVEAAGTPSSGVCKAETEPVQIQPATESKLKAREETHGTEEARGSTSRKRSRTAEMHNLAERRRREKINEKMKTLQQLIPRCNKVESDSVSTLISLLKFQRWMMLSSTSNRYRAKYKYALQNRMCFKPMVQHGKSSYVSSFVEMMSTGQGMMSPMMNAGNTQQFMPHMAMDMNRPPPFIPFPGTSFPMPAQMAGVGPSYPAPRYPFPNIQTFDPSRVRLPSPQPNPVSNQPQFPAYMNPYSQFAGPHQLQQPPPPPFQGQTTSQLSSGQASSSKEPEDQENQPTA

SEQ ID NO: 685 - DNA, 1003 bp, Arabidopsis thaliana
tgtggaggaatattaatacagcccacttcacatctatttttgtgcaaccatctctctaaagcttcttctctcataacaatggcaagacaaatcaacatagagagtagtgtttctcaagttacctttatctcctccgccatccccgccgtatcttcctcctcctccatcaccgcttccgcctcattgtcctcttcacctactacatcttcctcttcttcgtcatcaacaaattctaacttcattgaggaagacaactctaaaagaaaagcatctcgaagatcattgtcatcgttagtctccgttgaagacgatgatgatcaaaacggtggaggtgggaaacggcgaaagaccaacggtggagataaacatccgacgtatagaggagtgaggatgaggagttggggaaaatgggtgtcggagattagagagccgagaaagaaatcaagaatctggctcgggacttatccaacggctgagatggcagctcgagctcatgacgtagcggctttagccattaaaggtacaacggcttacctcaattttcccaagttagccggcgagcttcctcgtccagtcacaaattctcctaaagacattcaagccgccgcctctttagcggccgttaactggcaagattcggtcaacgatgtgagtaattctgaagtggctgaaatagttgaagccgagccgagtcgagccgtggtggctcagttgttttcttcggacacaagcacgacgacgacgactcagagtcaagagtattcggaagcttcgtgtgcttcgacttcggcgtgtacggacaaagacagtgaggaagagaagctgtttgatttgccggatttgtttaccgatgagaatgagatgatgatacgaaacgatgcgttttgctactactcgtccacgtggcagctttgtggagccgatgctgggtttcggcttgaagagccgttttttctatctgaatgactaaagtacccctctcgagagagctctcactaacact

SEQ ID NO: 686 - protein, 295 aa, Arabidopsis thaliana
MARQINIESSVSQVTFISSAIPAVSSSSSITASASLSSSPTTSSSSSSSTNSNFIEEDNSKRKASRRSLSSLVSVEDDDDQNGGGGKRRKTNGGDKHPTYRGVRMRSWGKWVSEIREPRKKSRIWLGTYPTAEMAARAHDVAALAIKGTTAYLNFPKLAGELPRPVTNSPKDIQAAASLAAVNWQDSVNDVSNSEVAEIVEAEPSRAVVAQLFSSDTSTTTTTQSQEYSEASCASTSACTDKDSEEEKLFDLPDLFTDENEMMIRNDAFCYYSSTWQLCGADAGFRLEEPFFLSE

SEQ ID NO: 687 - DNA, 1064 bp, Arabidopsis thaliana
attctgttacttagtaccggagtttagtcggagagagaacaatgatcagtttcagagaagagaacatcgatctcaacttgattaaaacaattagtgtaatctgtaatgatccagacgccaccgattcctctagcgacgatgaatctatctccggcaataatcctcgccgtcagatcaaaccaaaaccaccgaaacgttacgtctcaaagatctgtgtcccgacgctgatcaaaaggtatgagaacgtttcgaattctacagggaataaagcagccggaaaccggaaaacgtcgtcgggtttcaaaggcgtacgacggaggccgtgggggaaatttgcggcggagataagaaatccgtttgagaagaagagaaagtggcttggaacgtttcctactgaagaagaagcagcagaagcttaccaaaagagtaaaagagagtttgatgaacgattgggtttagttaaacaggaaaaagacctagtagatttgaccaagccgtgcggtgtacgtaaaccagaagagaaggaagttactgagaagtcgaattgcaaaaaggtaaataagagaattgttactgatcagaagccatttggttgtggttataacgctgatcatgaagaagagggagtgattagtaaaatgttggaagatccgttgatgacatcgtcaattgctgatatttttggtgattcggctgttgaagcaaatgatatttgggtggattacaattcagtggaatttatttccattgtagatgatttcaagtttgattttgtggagaatgatagagtaggaaaggagaaaacatttggatttaagattggggatcacactaaagttaatcaacatgccaaaatcgtatcgaccaatggggacttattcgtcgatgatttacttgattttgatccgttgatagatgattttaagttagaagattttcctatggatgatcttggattattaggagatccagaggatgatgattttagttggtttaatggtactactgattggatcgataagtttttatgaatactttcttgacacggccaacggtattagtac

SEQ ID NO: 688 - protein, 329 aa, Arabidopsis thaliana
MISFREENIDLNLIKTISVICNDPDATDSSSDDESISGNNPRRQIKPKPPKRYVSKICVPTLIKRYENVSNSTGNKAAGNRKTSSGFKGVRRRPWGKFAAEIRNPFEKKRKWLGTFPTEEEAAEAYQKSKREFDERLGLVKQEKDLVDLTKPCGVRKPEEKEVTEKSNCKKVNKRIVTDQKPFGCGYNADHEEEGVISKMLEDPLMTSSIADIFGDSAVEANDIWVDYNSVEFISIVDDFKFDFVENDRVGKEKTFGFKIGDHTKVNQHAKIVSTNGDLFVDDLLDFDPLIDDFKLEDFPMDDLGLLGDPEDDDFSWFNGTTDWIDKFL

SEQ ID NO: 689 - DNA, 777 bp, Arabidopsis thaliana
atggacgtttttgttgatggtgaattggagtctctcttggggatgttcaactttgatcaatgttcatcatctaaagaggagagaccgcgagacgagttgcttggcctctctagcctttacaatggtcatcttcatcaacatcaacaccataacaatgtcttatcttctgatcatcatgctttcttgctccctgatatgttcccatttggtgcaatgccgggaggaaatcttccggccatgcttgattcttgggatcaaagtcatcacctccaagaaacgtcttctcttaagaggaaactacttgacgtggagaatctatgcaaaactaactctaactgtgacgtcacaagacaagagcttgcgaaatccaagaaaaaacagagggtaagctcggaaagcaatacagttgacgagagcaacactaattgggtagatggtcagagtttaagcaacagttcagatgatgagaaagcttcggtcacaagtgttaaaggcaaaactagagccaccaaagggacagccactgatcctcaaagcctttatgctcggaaacgaagagagaagattaacgaaaggctcaagacactacaaaaccttgtgccaaacgggacaaaagtcgatataagcacgatgcttgaagaagcggtccattacgtgaagttcttgcagcttcagattaagttgttgagctcggatgatctatggatgtacgcaccattggcttacaacggcctggacatggggttccatcacaaccttttgtctcggcttatgtga

SEQ ID NO: 690 - protein, 258 aa, Arabidopsis thaliana
MDVFVDGELESLLGMFNFDQCSSSKEERPRDELLGLSSLYNGHLHQHQHHNNVLSSDHHAFLLPDMFPFGAMPGGNLPAMLDSWDQSHHLQETSSLKRKLLDVENLCKTNSNCDVTRQELAKSKKKQRVSSESNTVDESNTNWVDGQSLSNSSDDEKASVTSVKGKTRATKGTATDPQSLYARKRREKINERLKTLQNLVPNGTKVDISTMLEEAVHYVKFLQLQIKLLSSDDLWMYAPLAYNGLDMGFHHNLLSRLM

SEQ ID NO: 691 - DNA, 970 bp, Arabidopsis thaliana
tatcaaacgagagtacaaaagatgacgtcactcaacagctctgcatcaccaacatcatcgtcatcagaccaatctgatgcaactactacaacaagcacccacttgtctgaagaagaagctccacccagaaacaacaacacaagaaagagaaggagagattcttcttctgcttcttcatcttcttcaatgcaacatcctgtttacagaggtgtgcggatgagaagttggggcaaatgggtctccgagatccgacaacctcgtaagaaaactcgtatttggctcggcacttttgtcaccgctgatatggctgctcgtgctcacgacgtcgctgctctcaccatcaaaggctcctccgccgtcttaaatttccctgagcttgcttctctcttccctcgtccggcgtcatcatcgccgcatgatatccagacagccgccgcagaagccgccgccatggtggtcgaagaaaaactgttagagaaggatgaggctccggaggccccaccttcgtcggaatcttcttacgtggcggcggagtcagaggatgaggagaggttggagaaaattgtggagctgcctaacattgaagaaggaagttatgacgagagtgtgacatcacgtgctgatctggcttattctgagccgttcgattgttgggtgtatcctccggttatggatttttatgaagaaatatcggagtttaatttcgtggaattgtggagctttaatcactaattaagttaggaaagtgcattatattgcaatattgcatcatagataacatttgtatttcttttctttttgtacggatacgtagcatatgctactatactagggctagtgtaccaaatattgtaaaatatacttattaatatttatgtaaatgtgtaatatatataacatacaattattgtaagtttggaaattggaaactatcgttacgcaatgttcttgtaaaaaaaaaaaaaaaaaa

SEQ ID NO: 692 - protein, 236 aa, Arabidopsis thaliana
MTSLNSSASPTSSSSDQSDATTTTSTHLSEEEAPPRNNNTRKRRRDSSSASSSSSMQHPVYRGVRMRSWGKWVSEIRQPRKKTRIWLGTFVTADMAARAHDVAALTIKGSSAVLNFPELASLFPRPASSSPHDIQTAAAEAAAMVVEEKLLEKDEAPEAPPSSESSYVAAESEDEERLEKIVELPNIEEGSYDESVTSRADLAYSEPFDCWVYPPVMDFYEEISEFNFVELWSFNH

SEQ ID NO: 693 - DNA, 755 bp, Arabidopsis thaliana
cgtcgacacaatcgctcttccgtaacatattccacaaaacgatcttcttgtttcttgaatttttagccatctcttttttttttttctcattttctcggatactatggcttcgagtccacgctggacggaggacgacaacaggcgttttaagtcagctctgtcgcaattccctccggataacaagcgtttggtgaatgtcgcccagcatctgccgaaacctttggaggaggtgaagtactactacgaaaagttggtcaacgatgtttatctgccgaaacctttagagaatgtcacccagcatctgcagaaacctatggaaatggaggagatgaagtacatgtacgaaaagatggccaacgatgttaatcagatgcccgagtacgtaccactggcggaatcgagtcagtccaaacgcaggaagaaggatacgccaaatccttggacagaagaggaacacagattgtttctgcaaggattgaaaaagtatggggaaggagcttcgacgttgacatcaacgaattttgtgaagacaaagactccacggcaagtgtcaagccatgcacagtattacaaaaggcaaaaatcggacaataagaaggagaaacgccggagtatttttgacataactttggagtctaccgagggcaatccagattctggaaatcagaaccctccggatgatgatgatccgtcccaaggtcaaggcacttgtcttggagtttagatgttggaagatagaagaatggtgtgaaagc

SEQ ID NO: 694 - protein, 206 aa, Arabidopsis thaliana
MASSPRWTEDDNRRFKSALSQFPPDNKRLVNVAQHLPKPLEEVKYYYEKLVNDVYLPKPLENVTQHLQKPMEMEEMKYMYEKMANDVNQMPEYVPLAESSQSKRRKKDTPNPWTEEEHRLFLQGLKKYGEGASTLTSTNFVKTKTPRQVSSHAQYYKRQKSDNKKEKRRSIFDITLESTEGNPDSGNQNPPDDDDPSQGQGTCLGV

SEQ ID NO: 695 - DNA, 573 bp, Arabidopsis thaliana
atgacttcttcaatccatgagctttctgataacattggaagtcatgagaagcaagaacagagagattctcatttccaaccaccaatcccttctgcaagaaattatgaatcaattgttacaagtttagtctactcagacccggggactacaaattccatggcacctggacaatatccatatccagatccttactacagaagcatatttgcaccgcctccacaaccgtataccggggtacatctacagttgatgggagtgcagcaacaaggcgttcctttaccatctgatgcagtcgaggaacctgtttttgttaacgcaaagcaataccacggtatactaaggcgcagacaatcaagagcaagacttgagtctcagaataaagtcatcaagtcacgtaagccgtatttgcatgaatctcggcatttgcatgcgataagacgaccaagaggatgtggcgggcggtttctaaatgccaagaaggaggatgagcatcacgaagacagtagtcatgaagaaaaatccaaccttagcgctggtaaatccgccatggctgcttctagtggtacatcttga

SEQ ID NO: 696 - protein, 190 aa, Arabidopsis thaliana
MTSSIHELSDNIGSHEKQEQRDSHFQPPIPSARNYESIVTSLVYSDPGTTNSMAPGQYPYPDPYYRSIFAPPPQPYTGVHLQLMGVQQQGVPLPSDAVEEPVFVNAKQYHGILRRRQSRARLESQNKVIKSRKPYLHESRHLHAIRRPRGCGGRFLNAKKEDEHHEDSSHEEKSNLSAGKSAMAASSGTS

SEQ ID NO: 697 - DNA, 1997 bp, Arabidopsis thaliana
aacttcaacatacacataatctctcacttaaaaatatctctctctctctctctacaaaatcaattccaatgttggtgggaaagataagtggatatgaagataatactcgctctttggagcgagaaacatctgaaatcacttctcttctcagccaatttccggggaatactaatgtccttgttgttgacaccaatttcaccactctactcaacatgaaacaaatcatgaaacaatacgcttatcaagtgtctattgagacagatgcagaaaaagctcttgcgtttttgacaagctgcaaacatgaaatcaatattgtgatttgggattttcatatgcctggaattgatggacttcaagctctcaagagcattacttcaaagttggatttacctgtagtgattatgtctgatgataatcaaacggaatctgtgatgaaagcaacattttacggtgcttgtgactatgttgtgaaaccggttaaagaagaggtaatggccaatatatggcaacacattgtacggaagaggctgatctttaaaccggatgttgctccaccggttcaatcagatccggctcgctctgaccgtttagaccaagtcaaagctgatttcaagatcgtagaagatgaaccaataatcaatgagacaccgctgatcacatggaccgaagaaattcaaccggttcagtcagatctggttcaagccaacaagttcgaccaagtgaatggctattccccaatcatgaaccaagataacatgttcaacaaagcaccacctaaaccgcgaatgacgtggacagaagttattcaaccggttcaatcaaatctggttcaaacaaaagagttcggccaactcaatgactattcccaaatcatgaaccaagatagcatgtacaacaaagcagcaaccaaaccacaattgacgtggaccgaagaaattcaaccggttcaatcaggtctggttcaagccaacgagttcagcaaagtgaatggatattcccaaagcatgaaccaagatagcatgttcaacaaatcagcaaccaacccgcgattgacatggaacgaattacttcaaccggttcaatcagatctggttcaatccaatgagtttagccaattcagtgactattctcaaatcatgaacgaagataacatgttcaacaaagcagcaaagaaaccgcggatgacatggagtgaagtatttcaaccggttcaatcacatctggttccgactgacggtttagaccgagaccactttgattccataaccataaacggaggtaacggcatacaaaacatggaaaagaaacaaggaaaaaaaccacggaagccgcggatgacgtggaccgaagagcttcaccaaaaatttctggaagccatcgaaataattggtggtatcgaaaaagctaacccaaaggtacttgtcgaatgcttgcaagaaatgaggatagaaggaattactagaagcaatgtggcaagtcatcttcagaaacaccgtatcaatcttgaagaaaaccaaattcctcaacaaacacaagggaatggttgggccactgcgtatggtacactagctccctctctccaaggttcagacaatgtcaacacaacaataccatcgtaccttatgaatggtccagccactttgaaccaaatccagcagaatcaatatcaaaatggtttcttgacaatgaacaacaaccagatcataaccaatcctccgcctcctttgccctatttggaccatcatcaccaacagcaacatcagtcttctcctcaatttaattacctgatgaacaatgaagaacttcttcaagcctctggcctctctgcgacagatcttgaactcacttatccaagtttaccatatgatccacaagagtatctaatcaatggctacaattataattagtcatatagcccttctctttacttaaggcagtctatgtatgacaaataatatgcgacttcccttgtgagtcacaatattgtttcattattc

SEQ ID NO: 698 - protein, 612 aa, Arabidopsis thaliana
MLVGKISGYEDNTRSLERETSEITSLLSQFPGNTNVLVVDTNFTTLLNMKQIMKQYAYQVSIETDAEKALAFLTSCKHEINIVIWDFHMPGIDGLQALKSITSKLDLPVVIMSDDNQTESVMKATFYGACDYVVKPVKEEVMANIWQHIVRKRLIFKPDVAPPVQSDPARSDRLDQVKADFKIVEDEPIINETPLITWTEEIQPVQSDLVQANKFDQVNGYSPIMNQDNMFNKAPPKPRMTWTEVIQPVQSNLVQTKEFGQLNDYSQIMNQDSMYNKAATKPQLTWTEEIQPVQSGLVQANEFSKVNGYSQSMNQDSMFNKSATNPRLTWNELLQPVQSDLVQSNEFSQFSDYSQIMNEDNMFNKAAKKPRMTWSEVFQPVQSHLVPTDGLDRDHFDSITINGGNGIQNMEKKQGKKPRKPRMTWTEELHQKFLEAIEIIGGIEKANPKVLVECLQEMRIEGITRSNVASHLQKHRINLEENQIPQQTQGNGWATAYGTLAPSLQGSDNVNTTIPSYLMNGPATLNQIQQNQYQNGFLTMNNNQIITNPPPPLPYLDHHHQQQHQSSPQFNYLMNNEELLQASGLSATDLELTYPSLPYDPQEYLINGYNYN

SEQ ID NO: 699 - DNA, 931 bp, Arabidopsis thaliana
tcctcactctctctctttttctctaaccataaaatctctttgatctctttctctgtgttttgataatggaaaatgttggtgttgggatgccgttttacgatttagggcaaacaagggtttacccactcttgtctgatttccacgatttatcggcggagaggtatccggtagggttcatggatttactgggtgttcatcgtcatacacccacccatacgccgttgatgcattttccgaccacacctaactcgtcctcgagcgaagctgtgaatggagatgacgaagaagaagaagatggagaagaacagcagcataagacaaagaagcggtttaaattcactaaaatgagtagaaagcagacgaagaagaaggtgccaaaagtgtcattcatcacgaggagtgaggttcttcatctagatgatggttataagtggagaaaatacggtcaaaaacctgtcaaagacagcccttttccaagaaattattaccgttgcacaacaacttggtgtgacgtgaagaagagagtagagagatcattcagtgatccaagcagtgtaatcaccacttacgaaggtcaacatactcatcctcgtccactactcatcatgcccaaagaaggcagctctccatccaatggctcagcttctagggcccacattggcctccctacactccctcctcagcttttagattacaacaaccaacaacaacaagcgccgtcttcttttggaaccgagtacattaacaggcaagaaaaaggaattaatcatgatgatgatgacgatcatgttgtgaagaagagtcgaactcgggatctgctggatggagctggtttagtcaaagatcatggccttcttcaggatgttgttccctctcatatcattaaggaagagtattagttaatcgcataattatgtagctagctagctag

SEQ ID NO: 700 - protein, 277 aa, Arabidopsis thaliana
MENVGVGMPFYDLGQTRVYPLLSDFHDLSAERYPVGFMDLLGVHRHTPTHTPLMHFPTTPNSSSSEAVNGDDEEEEDGEEQQHKTKKRFKFTKMSRKQTKKKVPKVSFITRSEVLHLDDGYKWRKYGQKPVKDSPFPRNYYRCTTTWCDVKKRVERSFSDPSSVITTYEGQHTHPRPLLIMPKEGSSPSNGSASRAHIGLPTLPPQLLDYNNQQQQAPSSFGTEYINRQEKGINHDDDDDHVVKKSRTRDLLDGAGLVKDHGLLQDVVPSHIIKEEY

SEQ ID NO: 701 - DNA, 992 bp, Arabidopsis thaliana
attctccacaatttcataactttcttccgctcaacttcagataaattcggattctgtagctctttcaatacgactgcggagatcagagccaattatttggttatggcgtctctgatctcagatattgaaccgccgacgagtactacttcagatctcgttcggagaaagaagagatcctctgcttcatccgccgcatcgtctcgttcaagcgcatcttccgtctccggtgagattcacgcgcgatggcgatcggagaagcaacaacggatctactcagccaaactgttccaagcgctccaacaagtccgcctcaactcttccgcctcaacatcatcatctccaacggctcagaaacgaggaaaggccgtccgtgaagccgccgatcgagctcttgccgtttccgctcggggaagaacactctggagcagagcgatcttagctaatcggatcaaactgaaatttcgtaaacagagacgtcctcgagctacgatggcgattccggccatgactacggtggttagtagcagcagcaacagatcgagaaaacggagagtgtcggtgttgagattgaataagaagagtataccggatgttaaccggaaagtacgtgttctaggccggttagttcccggttgcggtaaacaatccgtaccggtgattctagaagaagcaactgattatattcaggctctggagatgcaagtgagagccatgaactctttagttcagcttctctcctcctacggctcagctcctccaccgatttgatgaggttaaaatcgtctttttaattctaccatctctcgatctttcacagcttatgtgtatatagaagattcggtttgattataatctgtaactactcttcccaaccgctgattcttctctgctacaagtaaaagtaaattttgaaccgagtcttcccatttttacgatcctcaagtctaaattaagtatatgattgattaataaagtctttaccattagggttc

SEQ ID NO: 702 - protein, 221 aa, Arabidopsis thaliana
MASLISDIEPPTSTTSDLVRRKKRSSASSAASSRSSASSVSGEIHARWRSEKQQRIYSAKLFQALQQVRLNSSASTSSSPTAQKRGKAVREAADRALAVSARGRTLWSRAILANRIKLKFRKQRRPRATMAIPAMTTVVSSSSNRSRKRRVSVLRLNKKSIPDVNRKVRVLGRLVPGCGKQSVPVILEEATDYIQALEMQVRAMNSLVQLLSSYGSAPPPI

SEQ ID NO: 703 - DNA, 998 bp, Arabidopsis thaliana
agtgaccaccctgctggttaatcaacaccaagagaccttgtaatatataagttaggaagatgagagagaagtgggaaatgaaaagagatgaaatgggacatcgatgttgtggaaaacacaaagtgaagagaggtctttggtctccagaggaagacgagaagcttcttcgttatatcaccactcatggtcatcctagttggagttccgttccaaagcttgccgggttgcagagatgtgggaagagttgcagattaaggtggataaactatctaaggcctgatctgaggagaggttcgtttaatgaggaagaagagcagattatcatcgacgtacatcgtattcttggtaacaaatgggctcagattgctaagcacttacctggacgcactgataatgaagtcaagaacttttggaactcatgcattaagaagaaacttctttctcaaggcttagatccttctacacataatcttatgccttcacacaaaagatcttcttcttcaaacaataataatatccccaagccaaacaaaacgacgtccatcatgaagaaccctactgatcttgatcaatcaaccactgctttttcaatcacaaacatcaatccacccacttccactaaaccaaacaaacttaaatctcctaaccagactacaatcccatctcaaaccgtgatccctatcaatgataacatgtcaagtactcaaaccatgatccctatcaatgatcccatgtcaagtcttttagatgatgagaatatgattcctcactggtcagatgttgatggaatggcgatccacgaagctccgatgttgcctagtgataaggcagtagtgggagtggatgatgatgatctcaacatggacattttgtttaacactccttcttcttctgcttttgatcctgattttgcttccattttctcctctgcaatgtctatcgatttcaatcccatggatgatcttggcagctggaccttttagcttttactctacagc

SEQ ID NO: 704 - protein, 307 aa, Arabidopsis thaliana
MREKWEMKRDEMGHRCCGKHKVKRGLWSPEEDEKLLRYITTHGHPSWSSVPKLAGLQRCGKSCRLRWINYLRPDLRRGSFNEEEEQIIIDVHRILGNKWAQIAKHLPGRTDNEVKNFWNSCIKKKLLSQGLDPSTHNLMPSHKRSSSSNNNNIPKPNKTTSIMKNPTDLDQSTTAFSITNINPPTSTKPNKLKSPNQTTIPSQTVIPINDNMSSTQTMIPINDPMSSLLDDENMIPHWSDVDGMAIHEAPMLPSDKAVVGVDDDDLNMDILFNTPSSSAFDPDFASIFSSAMSIDFNPMDDLGSWTF

SEQ ID NO: 705 - DNA, 983 bp, Arabidopsis thaliana
aagttaatatgagaataatgagaaaaccactttcccaaattgctttttaaaatccctcctcacacagattccttccttcatcacctcacacactctctacgcttgacatggccttcgatctccaccatggctcagcttcagatacgcattcatcagaacttccgtcgttttctctcccaccttatcctcagatgataatggaagcgattgagtccttgaacgataagaacggctgcaacaaaacgacgattgctaagcacatcgagtcgactcaacaaactctaccgccgtcacacatgacgctgctcagctaccatctcaaccagatgaagaaaaccggtcagctaatcatggtgaagaacaattatatgaaaccagatccagatgctcctcctaagcgtggtcgtggccgtcctccgaagcagaagactcaggccgaatctgacgccgctgctgctgctgttgttgctgccaccgtcgtctctacagatccgcctagatctcgtggccgtccaccgaagccgaaagatccatcggagcctccccaggagaaggtcattaccggatctggaaggccacgaggacgaccaccgaagagaccgagaacagattcggagacggttgctgcgccggaaccggcagctcaggcgacaggtgagcgtaggggacgtgggagacctccgaaggtgaagccgacggtggttgctccggttgggtgctgaattaatcggtacttatgcaatttcggaatctttagttactgaaaaatggaatctcttagagagtaagagagtgctttaatttagcttaattagatttatttggatttctttcagtatttggattgtaaactttagaatttgtgtgtgtgttgttgcttagtcctgagataagatataacattagcgactgtgtattattattattactgcattgtgttatgtgaaactttgttctcttgttgaaaaaaaaaaaaaaaaaaa

SEQ ID NO: 706 - protein, 204 aa, Arabidopsis thaliana
MAFDLHHGSASDTHSSELPSFSLPPYPQMIMEAIESLNDKNGCNKTTIAKHIESTQQTLPPSHMTLLSYHLNQMKKTGQLIMVKNNYMKPDPDAPPKRGRGRPPKQKTQAESDAAAAAVVAATVVSTDPPRSRGRPPKPKDPSEPPQEKVITGSGRPRGRPPKRPRTDSETVAAPEPAAQATGERRGRGRPPKVKPTVVAPVGC

SEQ ID NO: 707 - DNA, 759 bp, Arabidopsis thaliana
gtttgtcttttatcaatggaaagagaacaagaagagtctacgatgagaaagagaaggcagccacctcaagaagaagtgcctaaccacgtggctacaaggaagccgtacagagggatacggaggaggaagtggggcaagtgggtggctgagattcgtgagcctaacaaacgctcacggctttggcttggctcttacacaaccgatatcgccgccgctagagcctacgacgtggccgtcttctacctccgtggcccctccgcacgtctcaacttccctgatcttctcttgcaagaagaggaccatctctcagccgccaccaccgctgacatgcccgcagctcttataagggaaaaagcggcggaggtcggcgccagagtcgacgctcttctagcttctgccgctccttcgatggctcactccactccgccggtaataaaacccgacttgaatcaaatacccgaatccggagatatatagtcaatttatatacatgtagtttgttttgtttgattagaagattacatttacatacaagatacacatagatactggaaaatataggtatgtatacattcataaattatcttatgtatcaaagaattttatagattctgattagctttttgtttttgtttttgataagaactctgattagttgtccggagacaaaaccggctaagagcaatccatgagaagctagcgagtgttttttagttcaagttgtaatataaatgcatattaattctttagtaattttgt

SEQ ID NO: 708 - protein, 153 aa, Arabidopsis thaliana
MEREQEESTMRKRRQPPQEEVPNHVATRKPYRGIRRRKWGKWVAEIREPNKRSRLWLGSYTTDIAAARAYDVAVFYLRGPSARLNFPDLLLQEEDHLSAATTADMPAALIREKAAEVGARVDALLASAAPSMAHSTPPVIKPDLNQIPESGDI

SEQ ID NO: 709 - DNA, 795 bp, Arabidopsis thaliana
atggacgtctatggcttatcttcaccagacttacttcgaatcgacgaccttcttgatttctccaacgaagacatcttctccgcttcttcttccggtggttccaccgccgctacttcctcttcttctttccctcctcctcaaaaccctagtttccaccaccaccatctcccttcctccgccgatcatcactccttcctccacgacatttgcgttcccagtgatgacgcagctcatcttgaatggctttcgcaattcgtggacgattctttcgctgattttccggcgaatccattaggaggaactatgacttctgtcaaaactgaaacttcctttccggggaaaccaagaagcaaacgatcaagagctcctgctcctttcgccggaacatggtctccgatgccactggaatccgagcatcagcagcttcactccgccgccaaattcaagccaaagaaagaacaatccggcggaggaggaggaggaggaggaagacatcagtcatcgtcatcggagactacggaaggaggaggaatgaggagatgtactcactgtgcatcggagaaaacgccacagtggaggacaggaccacttggacctaaaacactatgtaacgcttgtggagtccggtttaaatccggtagacttgtaccggaatatagaccggcttcgagtcctacttttgttttgactcagcattcaaactctcaccggaaagtgatggagcttcgacggcagaaagaagttatgagacaaccacaacaagttcaacttcatcaccaccaccacccgttttag

SEQ ID NO: 710 - protein, 264 aa, Arabidopsis thaliana
MDVYGLSSPDLLRIDDLLDFSNEDIFSASSSGGSTAATSSSSFPPPQNPSFHHHHLPSSADHHSFLHDICVPSDDAAHLEWLSQFVDDSFADFPANPLGGTMTSVKTETSFPGKPRSKRSRAPAPFAGTWSPMPLESEHQQLHSAAKFKPKKEQSGGGGGGGGRHQSSSSETTEGGGMRRCTHCASEKTPQWRTGPLGPKTLCNACGVRFKSGRLVPEYRPASSPTFVLTQHSNSHRKVMELRRQKEVMRQPQQVQLHHHHHPF

SEQ ID NO: 711 - DNA, 780 bp, Arabidopsis thaliana
atgagaccaatattagacctcgaaattgaagcttcatcgggcagtagtagcagccaagtggcctcaaacttgtctccggttggggaagattacaaaccaatctcgctgaatcttagcctcagtttcaacaacaacaacaacaataatctggatcttgaatcatcgtctttgacgctgccactttcgagcacgagtgagagtagtaacccggagcagcagcagcaacaacaaccatctgtatcaaagagagtcttctcttgtaactactgccaaaggaagttctatagctctcaagcgctaggtggtcaccaaaacgctcacaaacgtgagagaacactcgccaaacgcgctatgctatgggtcttgctggggtcttccccggtagaggatcaagtagcaattatgcggctgctgccacagcagccgctctcgtgtttgccgcttcacggaagcggaaacgggaacatgacatcgttcaggactttgggaatccgggcacattcctcggcgcacgacgtcagcatgacaaggcagacaccagaaacacttattagaaacattgccaggttcaaccaggggtatttcggtaattgtatacctttttacgtggaggacgacgaggccgagatgctctggccggggagtttccggcaagctacgaatgcggttgcggttgaagcgggtaatgataatttaggtgaaagaaaaatggatttcttggacgtcaagcaagcgatggatatggaaagttctcttccagatctaaccttgaagctttga

SEQ ID NO: 712 - protein, 259 aa, Arabidopsis thaliana
MRPILDLEIEASSGSSSSQVASNLSPVGEDYKPISLNLSLSFNNNNNNNLDLESSSLTLPLSSTSESSNPEQQQQQQPSVSKRVFSCNYCQRKFYSSQALGGHQNAHKRERTLAKRAMLWVLLGSSPVEDQVAIMRLLPQQPLSCLPLHGSGNGNMTSFRTLGIRAHSSAHDVSMTRQTPETLIRNIARFNQGYFGNCIPFYVEDDEAEMLWPGSFRQATNAVAVEAGNDNLGERKMDFLDVKQAMDMESSLPDLTLKL

SEQ ID NO: 713 - DNA, 774 bp, Arabidopsis thaliana
atggacgaaaccaacggacgaagagaaactcacgatttcatgaacgtcaacgttgaatccttctctcagcttcctttcatccgccgtactcctcccaaagaaaaagccgccattattcgtctcttcggccaagagctcgtcggtgataactccgacaacttatccgcagaaccttctgatcatcaaaccactaccaagaacgatgagagctctgagaatatcaaggacaaagacaaagaaaaagataaggacaaagacaaagataacaacaacaacaggagattcgagtgtcactactgcttcagaaacttcccaacttctcaagccctaggtggacatcaaaacgctcacaaacgtgaacgtcaacacgccaaacgcggttccatgacatcataccttcatcatcatcagcctcatgaccctcaccacatctacggcttcctcaacaaccaccaccaccgtcactatccgtcttggacgacggaagctagatcatactacggcggagggggacatcaaacgccgtcgtactactcaaggaatactcttgctcctccttcttctaacccaccgacaatcaacggaagtcctttaggtttgtggcgtgtaccgccttccacgtcaacaaatactattcaaggcgtttactcatcttcaccagcttcagcgtttaggtcgcatgagcaagagactaataaggagcctaataactggccgtacagattgatgaaacccaatgtgcaagatcatgtgagtctcgatcttcatctctga

SEQ ID NO: 714 - protein, 257 aa, Arabidopsis thaliana
MDETNGRRETHDFMNVNVESFSQLPFIRRTPPKEKAAIIRLFGQELVGDNSDNLSAEPSDHQTTTKNDESSENIKDKDKEKDKDKDKDNNNNRRFECHYCFRNFPTSQALGGHQNAHKRERQHAKRGSMTSYLHHHQPHDPHHIYGFLNNHHHRHYPSWTTEARSYYGGGGHQTPSYYSRNTLAPPSSNPPTINGSPLGLWRVPPSTSTNTIQGVYSSSPASAFRSHEQETNKEPNNWPYRLMKPNVQDHVSLDLHL

SEQ ID NO: 715 - DNA, 2217 bp, Arabidopsis thaliana
tagggtttgctttcagtttccggagtataagaaaagatgttcgagccaaatatgctgcttgcggctatgaacaacgcagacagcaataaccacaactacaaccacgaagacaacaataatgaaggatttcttcgggacgatgaattcgacagtccgaatactaaatcgggaagtgagaatcaagaaggaggatcaggaaacgaccaagatcctcttcatcctaacaagaagaaacgatatcatcgacacacccaacttcagatccaggagatggaagcgttcttcaaagagtgtcctcacccagatgacaagcaaaggaaacagctaagccgtgaattgaatttggaacctcttcaggtcaaattctggttccaaaacaaacgtacccaaatgaagaatcatcacgagcggcatgagaactcacatcttcgggcggagaacgaaaagcttcgaaacgacaacctaagatatcgagaggctcttgcaaatgcttcgtgtcctaattgtggtggtccaacagctatcggagaaatgtcattcgacgaacaccaactccgtctcgaaaatgctcgattaagggaagagatcgaccgtatatccgcaatcgcagctaaatacgtaggcaagccagtctcaaactatccacttatgtctcctcctcctcttcctccacgtccactagaactcgccatgggaaatattggaggagaagcttatggaaacaatccaaacgatctccttaagtccatcactgcaccaacagaatctgacaaacctgtcatcatcgacttatccgtggctgcaatggaagagctcatgaggatggttcaagtagacgagcctctgtggaagagtttggctttagacgaagaagaatatgcaaggacctttcctagagggatcggacctagaccggctggatatagatcagaagcttcgcgagaaagcgcggttgtgatcatgaatcatgttaacatcgttgagattctcatggatgtgaatcaatggtcgacgattttcgcggggatggtttctagagcaatgacattagcggttttatcgacaggagttgcaggaaactataatggagctcttcaagtgatgagcgcagagtttcaagttccatctccattagtcccaacacgtgaaacctatttcgcacgttactgtaaacaacaaggagatggttcgtgggcggttgtcgatatttcgttggatagtctccaaccaaatcccccggctagatgcaggcggcgagcttcaggatgtttgattcaagaattgccaaatggatattctaaggtgacttgggtggagcatgtggaagttgatgacagaggagttcataacttatacaaacacatggttagtactggtcatgccttcggtgctaaacgctgggtagccattcttgaccgccaatgcgagcggttagctagtgtcatggctacaaacatttcctctggagaagttggcgtgataaccaaccaagaagggaggaggagtatgctgaaattggcagagcggatggttataagcttttgtgcaggagtgagtgcttcaaccgctcacacgtggactacattgtccggtacaggagctgaagatgttagagtgatgactaggaagagtgtggatgatccaggaaggtctcctggtattgttcttagtgcagccacttctttttggatccctgttcctccaaagcgagtctttgacttcctcagagacgagaattcaagaaatgagtgggatattctgtctaatggaggagttgtgcaagaaatggcacatattgctaacgggagggataccggaaactgtgtttctcttcttcgggtaaatagtgcaaactctagccagagcaatatgctgatcctacaagagagctgcattgatcctacagcttcctttgtgatctatgctccagtcgatattgtagctatgaacatagtgcttaatggaggtgatccagactatgtggctctgcttccatcaggttttgctattcttcctgatggtaatgccaatagtggagcccctggaggagatggagggtcgctcttgactgttgcttttcagattctggttgactcagttcctacggctaagctgtctcttggctctgttgcaactgtcaataatctaatagcttgcactgttgagagaatcaaagcttcaatgtcttgtgagactgcttgaaaaccatccattagc

SEQ ID NO: 716 - protein, 721 aa, Arabidopsis thaliana
MFEPNMLLAAMNNADSNNHNYNHEDNNNEGFLRDDEFDSPNTKSGSENQEGGSGNDQDPLHPNKKKRYHRHTQLQIQEMEAFFKECPHPDDKQRKQLSRELNLEPLQVKFWFQNKRTQMKNHHERHENSHLRAENEKLRNDNLRYREALANASCPNCGGPTAIGEMSFDEHQLRLENARLREEIDRISAIAAKYVGKPVSNYPLMSPPPLPPRPLELAMGNIGGEAYGNNPNDLLKSITAPTESDKPVIIDLSVAAMEELMRMVQVDEPLWKSLALDEEEYARTFPRGIGPRPAGYRSEASRESAVVIMNHVNIVEILMDVNQWSTIFAGMVSRAMTLAVLSTGVAGNYNGALQVMSAEFQVPSPLVPTRETYFARYCKQQGDGSWAVVDISLDSLQPNPPARCRRRASGCLIQELPNGYSKVTWVEHVEVDDRGVHNLYKHMVSTGHAFGAKRWVAILDRQCERLASVMATNISSGEVGVITNQEGRRSMLKLAERMVISFCAGVSASTAHTWTTLSGTGAEDVRVMTRKSVDDPGRSPGIVLSAATSFWIPVPPKRVFDFLRDENSRNEWDILSNGGVVQEMAHIANGRDTGNCVSLLRVNSANSSQSNMLILQESCIDPTASFVIYAPVDIVAMNIVLNGGDPDYVALLPSGFAILPDGNANSGAPGGDGGSLLTVAFQILVDSVPTAKLSLGSVATVNNLIACTVERIKASMSCETA

SEQ ID NO: 717 - DNA, 1177 bp, Arabidopsis thaliana; identical to SEQ ID NO: 105

SEQ ID NO: 718 - protein, 279 aa, Arabidopsis thaliana; identical to SEQ ID NO: 106

SEQ ID NO: 719 - DNA, 1507 bp, Arabidopsis thaliana
aaaaaatcactgtttcataacacgtttttctctctcacccaccaaaaaaaaatcttttgttcttgttaccaaaaaatctcgtgataaatctcttcaaactttgttttattttcttcttgattctctcgaaatctctctcaacaaacccagaaactttccttgattcgcaagcttttcttccttttatattcttcattttgatgcgaatatagagagagtccataaaagaaacagtaatggacgaatatattgatttccgaccattgaagtacacagagcacaagacttcaatgactaaatacaccaaaaagtcatcggaaaaactttccggtggtaagtcattgaaaaaggttagtatttgttatactgatcctgacgcaacagattcatcaagtgacgaagacgaagaagatttcttgtttcctcgccggagagtcaaaagattcgttaacgagatcactgttgagcctagctgtaacaacgtcgtcaccggagtttcgatgaaagatagaaagagactctcttcttcctccgatgaaactcaatctccggcgtcgagtcgtcaacgtcctaataacaaagtttcagtctccggtcagataaagaagttccgtggtgttagacaacggccatgggggaaatgggcggcggagattagagatccggagcaacgtcggaggatttggctcgggacttttgagacggcggaggaagctgccgtggtttatgataacgccgctataagactccgtggaccggacgctttaactaatttctccataccgcctcaagaagaggaagaagaagaagaaccggaaccggttattgaggagaaaccggttattatgacgacgccaacaccaacaacatcgagttctgaatcaactgaagaagatttacaacatctctcatctcctacttcggttctcaatcaccggtcagaagagattcaacaagtacaacaaccgtttaaatcagctaaacccgaaccgggggtttcaaatgcaccatggtggcataccgggtttaataccggtttaggtgaatcagacgattcatttcctttggatactccgtttcttgacaactatttcaatgaatcaccaccagagatgtcaatatttgaccaaccaatggatcaaattttctgtgaaaatgatgatatcttcaatgatatgttgttcttgggtggtgaaactatgaacattgaagatgagttaacaagttctagtatcaaagatatgggttcaacgtttagtgattttgatgattcattgatatcagatctattagttgcttaatatgatgatgagagtgaagaagaaaccatcaagcaaatatctatggtgtgactgaaaaattttggtgttacttttttttctttcataagttcatgagcttttttgtttcttttttttaataatttatttagttttgtcaggagcttgtaaaacagttttggagaaatagtggaaaaatagtttaattaaaaaaaaaaaaaaaaaaa

SEQ ID NO: 720 - protein, 354 aa, Arabidopsis thaliana
MDEYIDFRPLKYTEHKTSMTKYTKKSSEKLSGGKSLKKVSICYTDPDATDSSSDEDEEDFLFPRRRVKRFVNEITVEPSCNNVVTGVSMKDRKRLSSSSDETQSPASSRQRPNNKVSVSGQIKKFRGVRQRPWGKWAAEIRDPEQRRRIWLGTFETAEEAAVVYDNAAIRLRGPDALTNFSIPPQEEEEEEEPEPVIEEKPVIMTTPTPTTSSSESTEEDLQHLSSPTSVLNHRSEEIQQVQQPFKSAKPEPGVSNAPWWHTGFNTGLGESDDSFPLDTPFLDNYFNESPPEMSIFDQPMDQIFCENDDIFNDMLFLGGETMNIEDELTSSSIKDMGSTFSDFDDSLISDLLVA

SEQ ID NO: 721 - DNA, 1699 bp, Arabidopsis thaliana
ttttttttttgcaatctccccctaatctgttgtttctcgcttcttcttctgttaatcatctgtctttcaaaaagaaagaaaaaagaaaaattcgatttctgggtttgtttttgtcatacagaaaaaaatcaagcttatgaatttgtgtttaattttttgttttaatttgaaaggcaggttttttcagaacgagatcgttttttcaaatttcttctgattttacctctttttttcttcttagattttagtgaatcgagggtgaaatttttgattccctcttttcggatctacacagaggttgcttatttcaaaccttttagatccatttttttttaattttctcggaaaaatccctgtttctttacttttttataagtctcaggttcaattttttcggattcaaatttttattttaaatggcagctgctatgaatttgtacacttgtagcagatcgtttcaagactctggtggtgaactcatggacgcgcttgtaccttttatcaaaagcgtttccgattctccttcttcttcttctgcagcgtctgcgtctgcgtttcttcacccctctgcgttttctctccctcctctccccggttattacccggattcaacgttcttgacccaaccgttttcatacgggtcggatcttcaacaaaccgggtcattaatcggactcaacaacctctcttcttctcagatccaccagatccagtctcagatccatcatcctcttcctccgacgcatcacaacaacaacaactctttctcgaatcttctcagcccaaagccgttactgatgaagcaatctggagtcgctggatcttgtttcgcttacggttcaggtgttccttcgaagccgacgaagctttacagaggtgtgaggcaacgtcactggggaaaatgggtggctgagatccgtttgccgagaaatcggactcgtctctggcttgggacttttgacacggcggaggaagctgcgttggcctatgataaggcggcgtacaagctgcgcggcgatttcgcccggcttaacttccctaacctacgtcataacggatttcacatcggaggcgatttcggtgaatataaacctcttcactcctcagtcgacgctaagcttgaagctatttgtaaaagcatggcggagactcagaaacaggacaaatcgacgaaatcatcgaagaaacgtgagaagaaggtttcgtcgccagatctatcggagaaagtgaaggcggaggagaattcggtttcgatcggtggatctccaccggtgacggagtttgaagagtccaccgctggatcttcgccgttgtcggacttgacgttcgctgacccggaggagccgccgcagtggaacgagacgttctcgttggagaagtatccgtcgtacgagatcgattgggattcgattctagcttaggggcaaaataggaaattcagccgcttgcaatggagtttttgtgaaattgcatgactggcccaagagtaattaattaaatatggattagtgttaaatttcgtatgttaatatttgtattatggtttgtattagtctctctgtgtcggtccagcttgcggttttttgtcaggctcgaccatgccacagttttcattttatgtaatctttttttcttttgtcttatgtaatttgtagcttcagtttcttcatctataatgcaattttattatgattatgtg

SEQ ID NO: 722 - protein, 334 aa, Arabidopsis thaliana
MAAAMNLYTCSRSFQDSGGELMDALVPFIKSVSDSPSSSSAASASAFLHPSAFSLPPLPGYYPDSTFLTQPFSYGSDLQQTGSLIGLNNLSSSQIHQIQSQIHHPLPPTHHNNNNSFSNLLSPKPLLMKQSGVAGSCFAYGSGVPSKPTKLYRGVRQRHWGKWVAEIRLPRNRTRLWLGTFDTAEEAALAYDKAAYKLRGDFARLNFPNLRHNGFHIGGDFGEYKPLHSSVDAKLEAICKSMAETQKQDKSTKSSKKREKKVSSPDLSEKVKAEENSVSIGGSPPVTEFEESTAGSSPLSDLTFADPEEPPQWNETFSLEKYPSYEIDWDSILA

SEQ ID NO: 723 - DNA, 1374 bp, Arabidopsis thaliana
atggctgatccggcgattaagctctttggaaagacgattcctttacctgagcttggtgttgttgattcttcttctagctataccggatttttaaccgaaactcagattcctgttcggttatcagattcgtgtaccggcgatgatgatgatgaagagatgggtgattccggtttaggacgagaagaaggtgatgatgttggtgatggtggaggagagagcgagactgataaaaaggaagaaaaagatagtgagtgtcaggaagagtcattgaggaatgaatctaatgatgttactactactacatcgggtataactgaaaaaacggaaacaacaaaagctgcaaagacgaatgaagagtcaggtggtactgcttgctctcaagaggggaagttaaagaaacctgataagattctaccgtgtccgcgatgtaacagcatggaaaccaagttctgttactacaacaactataatgttaaccaacctcgccatttctgcaagaaatgtcagagatattggacagctggtggaacgatgaggaatgttccggttggtgctgggagacgtaagaataagagtccagcttctcattataaccgtcatgtaagtataacatctgcggaagctatgcagaaggtggcgagaactgatcttcaacatcctaatggtgcaaatcttctcacttttggctctgattctgtgctttgtgaatctatggcttctggattgaatcttgttgagaagtcattgttgaagacacaaactgtattgcaagaacccaatgaaggcttgaagattacggttccgttaaaccagacaaacgaagaagctggaacagtcagcccgttaccaaaagttccatgctttccaggaccaccaccaacttggccttacgcttggaacggagtttcgtggacgattttaccgttttaccctccaccggcttactggagctgcccgggggtttcaccgggggcatggaacagcttcacatggatgccacaacccaattcaccatctggttccaatccaaattctcctacactaggtaaacattcacgtgacgagaacgctgctgaaccaggaaccgcttttgatgaaaccgagtcacttggtagggagaaaagcaaacccgagagatgcttgtgggttcccaagacgctgaggattgatgatccagaggaagctgctaaaagttccatctgggaaacattagggatcaaaaaagacgaaaatgcggatactttcggagctttcagatcatcaaccaaagaaaaaagcagtctttctgaaggaagacttccgggaagaagaccggagttgcaagcgaatcctgctgctctttctaggtcagcaaacttccatgagagctcatag

SEQ ID NO: 724 - protein, 457 aa, Arabidopsis thaliana
MADPAIKLFGKTIPLPELGVVDSSSSYTGFLTETQIPVRLSDSCTGDDDDEEMGDSGLGREEGDDVGDGGGESETDKKEEKDSECQEESLRNESNDVTTTTSGITEKTETTKAAKTNEESGGTACSQEGKLKKPDKILPCPRCNSMETKFCYYNNYNVNQPRHFCKKCQRYWTAGGTMRNVPVGAGRRKNKSPASHYNRHVSITSAEAMQKVARTDLQHPNGANLLTFGSDSVLCESMASGLNLVEKSLLKTQTVLQEPNEGLKITVPLNQTNEEAGTVSPLPKVPCFPGPPPTWPYAWNGVSWTILPFYPPPAYWSCPGVSPGAWNSFTWMPQPNSPSGSNPNSPTLGKHSRDENAAEPGTAFDETESLGREKSKPERCLWVPKTLRIDDPEEAAKSSIWETLGIKKDENADTFGAFRSSTKEKSSLSEGRLPGRRPELQANPAALSRSANFHESS

SEQ ID NO: 725 - DNA, 1307 bp, Arabidopsis thaliana
cacagcattgcagctgtgaataactaaatggggagacattcttgctgttacaaacaaaagctgaggaaagggctttggtctcctgaagaagacgagaagcttcttactcacatcaccaatcacggccatggctgctggagctctgtccctaaactcgctggtttgcagagatgtgggaagagttgtcgactcgagcagatctggtaccgccgactaagatggatcaattacttgagacctgatttaaagagaggagctttttctcctgaagaagagaatctcatcgtcgaacttcatgccgtccttggaaacagatggtcacagattgcgtcaaggcttccgggtagaaccgacaacgagatcaagaatctatggaactcaagcatcaagaagaaactgaaacaaagaggcattgacccaaacacacacaagcccatctctgaagtggagagttttagcgacaaagacaaaccaacaacaagcaacaacaaaagaagcggtaacgatcacaagtctcctagttcctcttctgcgactaaccaagacttcttcctcgaaaggccatctgatttatccgactacttcggatttcagaagcttaacttcaactccaatctaggactctctgttacaactgattcttcactctgctcgatgattccgccgcagtttagccccgggaacatggttggttctgtccttcagacaccagtatgcgtaaagccctcgattagtcttcctcccgacaacaacagttcgagtcctatctccggaggagatcatgtgaaattggctgcaccaaactgggaatttcagacaaacaacaataatacctcaaatttcttcgacaatggcggattctcatggtctatcccaaattcttctacttcttcttcacaagtcaaaccaaatcataacttcgaagaaataaaatggtcagagtatttgaacacaccgttcttcatagggagtactgtacagagtcaaacctctcaaccaatctacatcaaatcagaaacagattacttagccaatgtttcaaacatgacagatccttggagccaaaacgagaacttgggcacaactgaaactagtgacgtgttctccaaggatcttcagagaatggccgtctcttttggtcagtccctttagcttttttctttctttctttcttatttctaacagatgtagagaacataaagatatacaaatacatacaatgtcaatacgtacagtggatttaagtgttctgtatatttcatgggcgagctgtctttatttttatgtttaaaaaaaaaaaaaaaaaa

SEQ ID NO: 726 - protein, 374 aa, Arabidopsis thaliana
MGRHSCCYKQKLRKGLWSPEEDEKLLTHITNHGHGCWSSVPKLAGLQRCGKSCRLEQIWYRRLRWINYLRPDLKRGAFSPEEENLIVELHAVLGNRWSQIASRLPGRTDNEIKNLWNSSIKKKLKQRGIDPNTHKPISEVESFSDKDKPTTSNNKRSGNDHKSPSSSSATNQDFFLERPSDLSDYFGFQKLNFNSNLGLSVTTDSSLCSMIPPQFSPGNMVGSVLQTPVCVKPSISLPPDNNSSSPISGGDHVKLAAPNWEFQTNNNNTSNFFDNGGFSWSIPNSSTSSSQVKPNHNFEEIKWSEYLNTPFFIGSTVQSQTSQPIYIKSETDYLANVSNMTDPWSQNENLGTTETSDVFSKDLQRMAVSFGQSL

SEQ ID NO: 727 - DNA, 2001 bp, Arabidopsis thaliana
tgcttaattccaatgccatcgtgatcgattcatctctctctctctcttccaattttcccaattcttttttaaaaccctaatttttcagatatctgattatctcttgtatttcttctactcgatttgctcccataaaaacccttactttcttcaagttctggttttcaccgattgatgggtcgtggctcagtgacgtcgcttgctcctgggttccgttttcacccgacggatgaggaacttgttcgctactaccttaagcgtaaggtctgcaacaaaccctttaagttcgatgctatttccgtcaccgacatatacaagtctgagccttgggatctaccagataagtcgaagctgaaaagtagagacttggaatggtacttctttagtatgctggataagaagtacagtaatggttccaagacgaatcgtgctacggagaaagggtattggaagacgactgggaaagatcgggagattcgtaatggttcaagagtcgttgggatgaagaagacacttgtttatcacaagggtcgagctcctcgtggtgaaaggaccaattgggttatgcatgagtatcggctttctgatgaggacttgaagaaagctggtgtgccacaagaagcatatgtgttatgtaggatattccagaaaagtggtacgggtcctaagaatggggagcagtatggtgctccttatcttgaggaggagtgggaagaagatggaatgacttatgtacctgctcaagatgctttcagtgaaggattggctttgaatgatgatgtttatgtcgatattgatgacattgacgagaagcccgaaaatctggtggtctatgatgccgttcctattctacctaactattgtcatggggaatcaagtaacaatgttgaatcaggcaattactcagactctggaaattacattcaaccaggaaacaatgttgtcgactctggtgggtactttgaacaaccaattgaaacttttgaggaagatcggaagcctattatacgggagggtagcattcagccttgttctctgtttccagaggaacaaattggctgtggtgtgcaagacgaaaatgtggtgaatctggaatcttccaacaataatgtgtttgtagctgatacatgctacagtgacattcctattgatcataactatttacccgatgagccattcatggatcctaataacaatcttccactcaacgatggtctgtacctggaaacgaatgatctcagctgtgctcaacaagatgattttaacttcgaagattatctcagcttctttgatgatgagggtttgacttttgacgattctctattaatgggacctgaagattttcttcccaaccaagaagcccttgaccagaaacctgcccctaaagaattggagaaggaggtcgcaggaggcaaagaggcagtggaggaaaaggaaagtggcgaaggatcttcttcaaaacaagatacagatttcaaggactttgattcagctccgaagtacccatttctcaaaaagacgagccacatgcttggagccattcctactccatcttcatttgcttcacagttccaaacaaaggacgcaatgcgtctacacgcagcacaatcttctggttcagttcacgtgactgcaggtatgatgagaatatcaaacatgactctagcagcggacagcggtatgggctggtcatatgacaagaacggtaacctcaacgtagtcctttcattcggggtagtccaacaggatgatgcgatgactgcctcgggaagcaagacaggaattacggcgacaagagctatgttagtcttcatgtgtttatgggttctcctactctctgttagcttcaaaatagtaaccatggtgtctgctcggtaataggatcaaagttgaatcgtctcaaagactttttttggtgtttgtacctctccaatcatatagcctttaactttggcagtgctttgctgctcaatatttaaattttaaaaaaaaaaaaaaaaa

SEQ ID NO: 728 - protein, 567 aa, Arabidopsis thaliana
MGRGSVTSLAPGFRFHPTDEELVRYYLKRKVCNKPFKFDAISVTDIYKSEPWDLPDKSKLKSRDLEWYFFSMLDKKYSNGSKTNRATEKGYWKTTGKDREIRNGSRVVGMKKTLVYHKGRAPRGERTNWVMHEYRLSDEDLKKAGVPQEAYVLCRIFQKSGTGPKNGEQYGAPYLEEEWEEDGMTYVPAQDAFSEGLALNDDVYVDIDDIDEKPENLVVYDAVPILPNYCHGESSNNVESGNYSDSGNYIQPGNNVVDSGGYFEQPIETFEEDRKPIIREGSIQPCSLFPEEQIGCGVQDENVVNLESSNNNVFVADTCYSDIPIDHNYLPDEPFMDPNNNLPLNDGLYLETNDLSCAQQDDFNFEDYLSFFDDEGLTFDDSLLMGPEDFLPNQEALDQKPAPKELEKEVAGGKEAVEEKESGEGSSSKQDTDFKDFDSAPKYPFLKKTSHMLGAIPTPSSFASQFQTKDAMRLHAAQSSGSVHVTAGMMRISNMTLAADSGMGWSYDKNGNLNVVLSFGVVQQDDAMTASGSKTGITATRAMLVFMCLWVLLLSVSFKIVTMVSAR

SEQ ID NO: 729 - DNA, 2079 bp, Arabidopsis thaliana
ttctttcatcgttgtgtctattataaatatatgtcaatttggtttctaaaaaattctaccattgattgattgatttttttttctttaagagatgaatttatttacaagaatctcatctcggactaagaaggccaatctttactacgtaaccctagttgctcttctctgcatcgctagctaccttctcggtatttggcaaaacacggcggttaatccacgcgccgccttcgatgattcagacggtacaccgtgcgagggattcaccagacctaattctacgaaagatctcgacttcgacgcgcatcacaacattcaagatccacctccggtgacggaaaccgccgttagtttcccgtcgtgtgccgccgcgttgagcgagcacacgccatgcgaagacgcgaagcgatcgttgaaattctcgagggagagattggagtataggcaaaggcattgtcccgagagagaagaaatcttgaagtgcagaattccggcgccgtacggttacaaaacgccgttccgatggccggcgagtcgtgacgtggcgtggttcgctaatgtgcctcacacggagcttacggttgagaaaaagaatcagaattgggtccggtacgagaatgatcggttttggttccctggtggaggtacgatgtttccacgtggcgctgatgcttacattgatgatatcggacggttgattgatctcagcgacggctctatccgtacagccatcgataccggttgcggggtggctagcttcggtgcatatcttttatcaagaaacattacaacgatgtcatttgcaccaagagacacacacgaagctcaagtccagttcgcactcgagcgtggtgtgccggcgatgatcggaatcatggctacaatccgcctaccgtacccttctagagcctttgatttagcacattgctctcgttgccttattccgtggggccaaaacgatggggcttacttgatggaggtggatagggttttaagaccaggagggtactggatactttctggaccgccgattaattggcagaaacggtggaaagggtgggaacggaccatggatgatttgaatgcagagcagactcagatcgagcaggtcgcgagaagcttgtgttggaagaaagttgttcaaagagatgatcttgctatttggcaaaaaccctttaaccacattgactgtaagaaaaccagagaggttttgaaaaatccggagttttgtcgtcatgatcaagatcccgacatggcctggtatacgaagatggattcttgtttgacaccattacctgaagttgatgacgctgaggatctaaagacggtggccggagggaaggtagaaaagtggccggctagattaaacgcgattcctccgagagtaaacaaaggcgctctcgaggaaatcacacctgaagctttcttggagaacacgaaactgtggaaacagagagtttcttattacaagaagttagattaccagttgggtgaaaccgggagatacagaaacttagtcgacatgaacgcttacctcggtggattcgcggcggctctagcggatgatccggtctgggtcatgaacgttgtcccggtcgaggctaagctcaatacgctcggtgtcatctacgagcgtggtctaatcggaacgtatcaaaactggtgtgaagccatgtcgacgtatccaagaacgtatgattttatccatgctgactcggttttcacattgtaccaaggtcaatgtgaaccggaggagatattgttggagatggaccgaattcttagaccgggtggtggtgtgattataagagatgacgtggacgttttgatcaaggttaaggaattaaccaaaggattagaatgggaaggtagaattgctgaccacgagaagggtcctcatgaaagagagaagatttactatgcggtgaaacagtattggaccgttcctgcgcctgatgaagataaaaacaacactagtgctctctcctgatttttgagttttttttttcttacaatgttttttttttttttttttcaattttttatacaacaataaattctcaataattgttgtcgcggccg

SEQ ID NO: 730 - protein, 631 aa, Arabidopsis thaliana
MNLFTRISSRTKKANLYYVTLVALLCIASYLLGIWQNTAVNPRAAFDDSDGTPCEGFTRPNSTKDLDFDAHHNIQDPPPVTETAVSFPSCAAALSEHTPCEDAKRSLKFSRERLEYRQRHCPEREEILKCRIPAPYGYKTPFRWPASRDVAWFANVPHTELTVEKKNQNWVRYENDRFWFPGGGTMFPRGADAYIDDIGRLIDLSDGSIRTAIDTGCGVASFGAYLLSRNITTMSFAPRDTHEAQVQFALERGVPAMIGIMATIRLPYPSRAFDLAHCSRCLIPWGQNDGAYLMEVDRVLRPGGYWILSGPPINWQKRWKGWERTMDDLNAEQTQIEQVARSLCWKKVVQRDDLAIWQKPFNHIDCKKTREVLKNPEFCRHDQDPDMAWYTKMDSCLTPLPEVDDAEDLKTVAGGKVEKWPARLNAIPPRVNKGALEEITPEAFLENTKLWKQRVSYYKKLDYQLGETGRYRNLVDMNAYLGGFAAALADDPVWVMNVVPVEAKLNTLGVIYERGLIGTYQNWCEAMSTYPRTYDFIHADSVFTLYQGQCEPEEILLEMDRILRPGGGVIIRDDVDVLIKVKELTKGLEWEGRIADHEKGPHEREKIYYAVKQYWTVPAPDEDKNNTSALS

SEQ ID NO: 731 - DNA, 1747 bp, Arabidopsis thaliana
tgcaaaaacattttcttgtctctcctctgcccaaattttttttctttccaggaatatttcctagaaaaacccaagcaaagctttaaccccttcctcctccaaaagtagcatcttcctctttttctatttctcctttcctcttcttatctctctctcgtttgtgaacgattccttaagaatataaccaaaagcccttttctcctttcttcaactttccgggaaaaatcttcacgcagcaaggtttctctctcggctctcgcagtgtttttcgggccttttgttctttctataaaaaaaaaattcgcgtcctttaagaaaactttttccacctagagaagaagaagagtatcactcttgttgttcaagtttctctctttaataaaaaatccatctttattctttgtcttctttcctttttgctttccctaatctctatgttataaacacacagagagaaacaaagtcacagtctcgagtcaaaaacagagaatacgaaagaaaaatggaagcggagaagaaaatggttctaccgagaatcaaattcacagagcacaaaaccaacacgacaacaatcgtatcggagttaaccaacactcaccaaaccaggattcttcgtatctcagtcactgacccagacgctactgattcctccagtgacgacgaagaagaagaacatcaacgctttgtctctaaacgccgtcgtgttaagaagtttgtcaacgaagtctatctcgattccggtgctgttgttactggtagttgtggtcaaatggagtcgaagaagagacaaaagagagcggttaaatcggagtctactgtttctccggttgtttcagcgacgacgactacgacgggagagaagaagttccgaggagtgagacagcgtccatggggaaaatgggcggcggagataagagatccgttgaaacgtgtacggctctggttaggtacttacaacacggcggaagaagctgctatggtttacgataacgccgctattcagcttcgtggtcccgacgctctgactaatttctcagtcactccgacaacagcgacggagaagaaagccccaccaccgtctccggtgaagaagaagaagaagaaaaacaacaaaagcaaaaaatccgttactgcttcttcctccatcagcagaagcagcagcaacgattgtctctgctctccggtgtctgttctccgatctcctttcgccgtcgacgaattctccggcatttcttcatcaccagtcgcggccgttgtagtcaaggaagagccatccatgacaacggtatctgaaactttctctgatttctcggcgcccttgttctcagatgatgacgtgttcgatttccggagctcagtggttcccgactatctcggcggcgatttatttggggaagatctattcacggcggatatgtgtacggatatgaacttcggattcgatttcggatccggattatccagctggcacatggaggaccattttcaagatatcggggatctattcgggtcggatcctcttttagctgtttaataatattttaaataaataaatagttataccggccgttactaaacggaaccggagaaagttttgtataccggtgacataaaatctcggttatgttcgtaatctttttttctttgttatatataaaaatatgaatgaaactgaattaatgtaagttaatggtgataattattaacgttttaagttttgaaaaaaaaaaaaaaaaaaaaaaaaaaa

SEQ ID NO: 732 - protein, 343 aa, Arabidopsis thaliana
MEAEKKMVLPRIKFTEHKTNTTTIVSELTNTHQTRILRISVTDPDATDSSSDDEEEEHQRFVSKRRRVKKFVNEVYLDSGAVVTGSCGQMESKKRQKRAVKSESTVSPVVSATTTTTGEKKFRGVRQRPWGKWAAEIRDPLKRVRLWLGTYNTAEEAAMVYDNAAIQLRGPDALTNFSVTPTTATEKKAPPPSPVKKKKKKNNKSKKSVTASSSISRSSSNDCLCSPVSVLRSPFAVDEFSGISSSPVAAVVVKEEPSMTTVSETFSDFSAPLFSDDDVFDFRSSVVPDYLGGDLFGEDLFTADMCTDMNFGFDFGSGLSSWHMEDHFQDIGDLFGSDPLLAV

SEQ ID NO: 733 - DNA, 1879 bp, Arabidopsis thaliana
tttttttttgtttgttaattttggggatcgatgtcggaaaaggaagaagctccgtcgacatcgaagtccaccggagctccgtcgcgtccgactttatctcttcctccacggccgtttagtgagatgttctttaacggtggcgttggattcagtcctggtccgatgactctggtctctaatatgttccctgattccgatgagtttaggtctttctctcagcttctcgctggagccatgtcttctccagcgactgcagctgctgctgctgctgctgcgacggctagtgattaccagagacttggtgaagggactaatagctctagtggtgatgttgacccgagattcaagcaaaacagaccaaccggtttgatgatttctcaatctcaatcgccgtcgatgttcaccgtaccgcctggtttaagtccagctatgttgctcgattcaccaagctttttgggtcttttctctcccgttcagggatcatatggaatgacacatcagcaagctctagctcaagtcactgctcaagcagttcaagccaatgccaatatgcaaccacaaacagagtaccctcctccctctcaagttcaatcattttcatcgggtcaagcgcagatcccgacctcggctccactaccagctcaaagagaaacctcagatgtaaccatcatagagcacaggtcacaacagcctctaaatgttgacaaaccagctgatgatggctataactggcgaaaatatgggcaaaagcaagttaaaggtagcgagtttccacgaagctattacaagtgtactaatccaggatgtcctgtcaagaagaaggttgagagatctcttgatggacaagtaacggagattatctacaaaggtcagcacaatcatgaacctcctcaaaacactaagcgaggtaacaaagataacaccgcgaatataaatgggagttcgataaataacaatcgcgggagttctgaattgggggcatcacagtttcaaactaatagctccaacaagactaagagagagcaacatgaagcagtaagtcaagctacgacaacagagcacttgtctgaggcaagtgacggtgaagaagttggtaatggagaaactgatgtgagagagaaagatgagaatgagcctgatcccaagagaagaagtacagaagttcggatttcagaaccagctcctgctgcttcacatagaactgtgacagagcctagaattattgtccaaacgacgagtgaagttgatcttctagatgatggatataggtggcgtaaatatggacagaaagttgtcaaagggaatccttatccgaggagctactacaagtgcacaacaccaggatgtggtgtgaggaaacatgtagagagagcagcaacagatccaaaagctgtagtaacaacatatgaaggaaaacataaccatgaccttcccgctgctaaatcaagcagccatgccgctgcagcggcacagttaaggccagataatcgacctggcggtttggctaacttaaatcaacagcagcagcaacagcccgttgcgcggctaaggcttaaagaagagcaaacaacttgagagaagaaaactcttgaccgtttttcattacaaaagctttcaaattccactcacacacttgtctgaaaaatctagcagtttgcaggaaagaaacagcttcaagaggttgtagttcttctatgttctggtgtaaaacttaaaagctttttagggttttcagatttctgtttactaatactgtatgtgaattcttttgtacatgaggaagaaaattacagggggatattttgtgttgtatcttttgtgttattgtttcagtaaaagataggtcttacattttgtgtaaaaaaaaaaaaaaaaaaaa

SEQ ID NO: 734 - protein, 514 aa, Arabidopsis thaliana
MSEKEEAPSTSKSTGAPSRPTLSLPPRPFSEMFFNGGVGFSPGPMTLVSNMFPDSDEFRSFSQLLAGAMSSPATAAAAAAAATASDYQRLGEGTNSSSGDVDPRFKQNRPTGLMISQSQSPSMFTVPPGLSPAMLLDSPSFLGLFSPVQGSYGMTHQQALAQVTAQAVQANANMQPQTEYPPPSQVQSFSSGQAQIPTSAPLPAQRETSDVTIIEHRSQQPLNVDKPADDGYNWRKYGQKQVKGSEFPRSYYKCTNPGCPVKKKVERSLDGQVTEIIYKGQHNHEPPQNTKRGNKDNTANINGSSINNNRGSSELGASQFQTNSSNKTKREQHEAVSQATTTEHLSEASDGEEVGNGETDVREKDENEPDPKRRSTEVRISEPAPAASHRTVTEPRIIVQTTSEVDLLDDGYRWRKYGQKVVKGNPYPRSYYKCTTPGCGVRKHVERAATDPKAVVTTYEGKHNHDLPAAKSSSHAAAAAQLRPDNRPGGLANLNQQQQQQPVARLRLKEEQTT

SEQ ID NO: 735 - DNA, 1083 bp, Arabidopsis thaliana
gaaaaaaagattcaaaaaccctagatttcacaaaatcgattggctgtcaaatttctctccggcgattttcctcgagtgaaattcggctcaaggtgattatagcgatcatcgaatcaaattgattgaagaggtacaaaggttagttactttgagctgaaagatgaacacgtcagaggtgagagtacctcgaggaaatcgacggaggaaagctgtgattgatctgaatgcggtacctgttgatcaagaagggacctctgcttctgttagaactcttacggtgcctattacaccgtctcagcctgctcctacgatgattgatgtcgatgctattgaggatgatgttattgaatcatccgctagtgcttttgctgaagctaaaagcaaatcaagaaatgcacgtcggagacctttgatggttgatgtagagtcaggaggtacgactagattccctgccaacataagcaacaaacgcagaaggattccttctagtgaatctgtcatcgactgtgagcatgcctctgtaaatgatgaagtcaacatgtcttcgagagtgtctagatcaaaggctccagctcctccaccagaagagccaaagtttacatgtccaatctgcatgtgtccctttacggaggagatgtcaaccaagtgcggtcacatcttctgcaagggatgtataaagatggcaatatctcgccagggcaaatgccctacttgtaggaaaaaggttactgcaaaagagctgattcgagttttccttccaaccactagatgagtggtccggcaacatcaccagccaccctgtctaatggtttatcagactatcctcctattcactttggaacattgaagggacttcgttgacttggtatttttgaatattttgctttgttggaagagaaatattcagtgatcaagaagccagaaggccctatcattcgatggatatcattggtaataactctttgtttttagttgttgttctatgtaatttaggtctctgcaaacctctcagtcgatactcttctctcttgatagatgataagatatatggaaaaaaaaattaatattgaatctttactaaaa

SEQ ID NO: 736 - protein, 203 aa, Arabidopsis thaliana
MNTSEVRVPRGNRRRKAVIDLNAVPVDQEGTSASVRTLTVPITPSQPAPTMIDVDAIEDDVIESSASAFAEAKSKSRNARRRPLMVDVESGGTTRFPANISNKRRRIPSSESVIDCEHASVNDEVNMSSRVSRSKAPAPPPEEPKFTCPICMCPFTEEMSTKCGHIFCKGCIKMAISRQGKCPTCRKKVTAKELIRVFLPTTR

SEQ ID NO: 737 - DNA, 648 bp, Arabidopsis thaliana
atggggaagaagaagtgcgagttatgttgtggtgtagcgagaatgtattgtgagtcagatcaagcgagtttatgttgggattgtgacggtaaagttcacggagctaattttctggtggcgaaacacatgcgttgtcttctatgtagcgcgtgtcagtcacacacgccttggaaagcttctgggctgaatcttggcccaactgtttctatctgtgagtcttgtttagctcgtaagaagaataacaacagctccctcgccgggagggatcagaatcttaaccaagaagaagagatcattggttgtaacgacggagctgagtcttatgatgaggaaagcgatgaggatgaagaagaagaagaagtggagaatcaggttgttccggctgcggtggagcaagaacttccggtggtgagttcgtcgtcttcggttagtagtggtgaaggagatcaggtggtgaaaaggacgagacttgatttggatcttaacctctccgatgaggagaaccaatctagaccattgaaaagattatcgagagacgaaggtttgtcaagatcaactgttgtgatgaatagctcaatcgtgaaattacacggagggaggagaaaagcagagggatgtgatacatcatcgtcgtcttcgttttattga

SEQ ID NO: 738 - protein, 215 aa, Arabidopsis thaliana
MGKKKCELCCGVARMYCESDQASLCWDCDGKVHGANFLVAKHMRCLLCSACQSHTPWKASGLNLGPTVSICESCLARKKNNNSSLAGRDQNLNQEEEIIGCNDGAESYDEESDEDEEEEEVENQVVPAAVEQELPVVSSSSSVSSGEGDQVVKRTRLDLDLNLSDEENQSRPLKRLSRDEGLSRSTVVMNSSIVKLHGGRRKAEGCDTSSSSSFY

SEQ ID NO: 739 - DNA, 890 bp, Arabidopsis thaliana
cattcaaaaacatcatatatatacacaaacacactttgatacaacaaaaaaaaacagaacacaaacaaaaacacattgtaacattagtttaagcattaagcttctttatgtcgaataataataattctccgaccaccgtgaatcaagaaacgacgacgtctcgtgaagtctcaatcacattgcctactgatcaatctcctcaaacctcaccaggatcatcttcttctccttcaccgagaccttccggtggatcaccggcgagaagaacggcgactggattatccggcaagcactctattttcagggggattcgactacgtaacggaaaatgggtatcggagattagagagccacgtaaaacgacaagaatttggctcgggacttatccggtaccggagatggctgccgccgcttacgacgtggctgcgttagctttaaaaggacccgacgccgttttgaattttcctggtttagctttgacttacgtggctccggtttcaaactctgctgcggatataagagcggctgctagtagagcagcggagatgaagcaaccggatcagggtggggatgagaaggtattggaaccggttcaacccggcaaagaggaagaattagaagaagtgtcgtgtaactcgtgttcgttggagtttatggatgaggaagcgatgttgaatatgccgactttgttgacggagatggctgaagggatgttgatgagtccaccgagaatgatgatacatccgacgatggaagatgattcgccggagaatcatgaaggagataatctttggagttataaatgaatccattgaagctgctctcttttttattgttttccggtcgaatgagattttccccctttttttttttctttttgggtcgctgtt

SEQ ID NO: 740 - protein, 232 aa, Arabidopsis thaliana
MSNNNNSPTTVNQETTTSREVSITLPTDQSPQTSPGSSSSPSPRPSGGSPARRTATGLSGKHSIFRGIRLRNGKWVSEIREPRKTTRIWLGTYPVPEMAAAAYDVAALALKGPDAVLNFPGLALTYVAPVSNSAADIRAAASRAAEMKQPDQGGDEKVLEPVQPGKEEELEEVSCNSCSLEFMDEEAMLNMPTLLTEMAEGMLMSPPRMMIHPTMEDDSPENHEGDNLWSYK

SEQ ID NO: 741 - DNA, 1199 bp, Arabidopsis thaliana
tggaaaaagtttgagtttttaattcgaatcgagaaaaaataaaaatgggttctttaggtgatgagcttagtttgggatcgatctttgggagaggagtttcgatgaatgttgtggcggttgagaaagttgatgaacatgttaagaagcttgaagaagagaagagaaagctcgaaagttgtcaacttgagcttcctctgtctttgcagattttaaacgatgcgattttgtatctgaaggataagagatgttcagagatggagactcaaccattgttgaaagatttcatttctgttaataaacctattcaaggagaaagaggaatagaattgctgaaaagagaggagctaatgagggagaagaagtttcagcaatggaaagctaatgatgatcacactagtaagatcaagagcaagcttgagattaagagaaatgaggagaaatctcctatgttgttgattccaaaggtggaaactggtttaggcctcggtttaagttcgagttcgataagaagaaaagggattgttgcctcatgtggctttacttctaactctatgccacaaccaccaacaccagcagtaccacaacaaccagcatttcttaagcagcaagctttacggaagcaaagaaggtgttggaatccagagttgcatcgccgatttgtcgatgcattgcaacagctaggtggaccgggagtggcaactcctaaacaaattagagaacatatgcaagaagaaggcttaaccaatgatgaagtcaagagtcatttacagaaatacaggttacacatcaggaagccaaattcgaatgcggagaaacaatcagcagttgttttagggtttaacttgtggaattcttcagcacaagatgaagaagagacatgtgaaggaggagaatcattgaagagaagcaatgcgcaatcagattctcctcaaggtcctttgcagttaccgtctacaacaacaacaactggtggagatagtagcatggaagatgttgaagatgctaagtctgagagctttcaactggagagattgagatcaccataaatctcaagaaaccaaactcttgatcacggttttgttattttggattcattactatatctattagtagtgaatgagaacaataattatagaaaggtttatagatatatatatagagaaaaagagagagtgaggatggttcaaattatttgcaga

SEQ ID NO: 742 - protein, 333 aa, Arabidopsis thaliana
MGSLGDELSLGSIFGRGVSMNVVAVEKVDEHVKKLEEEKRKLESCQLELPLSLQILNDAILYLKDKRCSEMETQPLLKDFISVNKPIQGERGIELLKREELMREKKFQQWKANDDHTSKIKSKLEIKRNEEKSPMLLIPKVETGLGLGLSSSSIRRKGIVASCGFTSNSMPQPPTPAVPQQPAFLKQQALRKQRRCWNPELHRRFVDALQQLGGPGVATPKQIREHMQEEGLTNDEVKSHLQKYRLHIRKPNSNAEKQSAVVLGFNLWNSSAQDEEETCEGGESLKRSNAQSDSPQGPLQLPSTTTTTGGDSSMEDVEDAKSESFQLERLRSP

SEQ ID NO: 743 - DNA, 1652 bp, Arabidopsis thaliana
taccgtcgacccacgcgtccgagtgtattcaaagtcggaaagaaaccctaaagaagaggattatgggtgctgtatcgatggagtcgcttcctttaggtttcagattcagacctaccgatgaagagctcgtcaatcactacctccgtctcaagatcaacggacgtcactccgatgtccgtgtcatccctgatatcgatgtctgcaaatgggaaccttgggatcttcctgctctctcggtgattaagacggatgatccagagtggttctttttctgccctcgtgatcggaaataccctaatggtcatcgctctaacagagcaactgactctggctattggaaagctactggtaaagatcgtagcatcaagtctaagaagactttaatcggtatgaagaagactcttgtcttctatcgtggacgagctcctaaaggtgagcggactaattggattatgcacgagtatcgtcccactcttaaggatcttgatggcacttcccctggccaaagcccttacgttctttgtcgcctcttccacaagcctgatgatcgggttaatggtgtcaagtccgatgaagcagcttttacggccagcaacaaatactcacctgatgatacatcatctgatcttgttcaagaaacaccttcctctgatgctgctgttgagaaaccatcagattattcaggtggatgcggttatgctcatagtaatagtaccgcagatgggacaatgattgaggcacctgaagagaatctttggttatcttgtgaccttgaagatcaaaaggcaccactaccgtgtatggattctatatatgctggtgatttcagttacgatgagattggattccaatttcaagatggtaccagcgaaccagatgtatcactaacagaattgttggaggaggtgttcaataaccctgatgacttctcttgcgaggaatcgatcagtcgagagaatccagcagtctcaccaaatgggatattttcatctgctaaaatgctgcagtctgcagcaccagaggatgctttcttcaacgacttcatggctttcactgatacagatgctgagatggcgcaattgcagtatggttcagaaggtggagcttctggttggccaagtgacactaattcatactatagtgatttggttcagcaagagcaaatgatcaatcataacacagagaacaacctcacagaagggagagggataaagatccgggctcgacagcctcagaaccggcagagtacaggattgataaaccagggtattgctccaaggagaatccgtctgcagctgcagtctaactctgaagtaaaagaacgagaggaggtgaatgaaggacacactgttattcccgaggccaaagaagctgcagctaaatactcagagaagagtggttctttggttaaacctcaaataaagctcagggcgcggggaactataggccaagtaaaaggagagagatttgcagacgacgaggtacaggtgcagagcacaaagagagagagagagagaatcaaatgtagtttaatgtaattagggatgatgcaatgttagcatgtttgtgtgttgtaacttaaaaacttatttaggaatctgataaaagttactgttgaaaaaagaaaaaaaaaaaaaaaaaaaaaaaaaaaa

SEQ ID NO: 744 - protein, 491 aa, Arabidopsis thaliana
MGAVSMESLPLGFRFRPTDEELVNHYLRLKINGRHSDVRVIPDIDVCKWEPWDLPALSVIKTDDPEWFFFCPRDRKYPNGHRSNRATDSGYWKATGKDRSIKSKKTLIGMKKTLVFYRGRAPKGERTNWIMHEYRPTLKDLDGTSPGQSPYVLCRLFHKPDDRVNGVKSDEAAFTASNKYSPDDTSSDLVQETPSSDAAVEKPSDYSGGCGYAHSNSTADGTMIEAPEENLWLSCDLEDQKAPLPCMDSIYAGDFSYDEIGFQFQDGTSEPDVSLTELLEEVFNNPDDFSCEESISRENPAVSPNGIFSSAKMLQSAAPEDAFFNDFMAFTDTDAEMAQLQYGSEGGASGWPSDTNSYYSDLVQQEQMINHNTENNLTEGRGIKIRARQPQNRQSTGLINQGIAPRRIRLQLQSNSEVKEREEVNEGHTVIPEAKEAAAKYSEKSGSLVKPQIKLRARGTIGQVKGERFADDEVQVQSTKRERERIKCSLM

SEQ ID NO: 745 - DNA, 789 bp, Arabidopsis thaliana
gaaaaatggaagaagaaaagagattggagctaaggctagctcctccttgtcaccaattcacttccaacaacaacatcaatggatctaaacaaaaaagctcgaccaaagaaacatcattcctttccaataacagggttgaggtagctccagtggtgggatggccgccggtgagatcatcccggagaaacctaacggcacaactaaaggaggagatgaagaagaaggagagtgatgaagagaaggaattgtacgttaagatcaacatggaaggagttccaataggaagaaaagtcaacctttcagcttataacaactaccaacagctttcacatgccgttgaccaactcttctctaagaaagattcgtgggatctaaacagacaatacactttggtctacgaagacactgaaggagataaagttctggtcggggatgttccttgggagatgtttgtatctactgtaaagaggttgcatgttttaaagacctcccacgccttctcactctcacctagaaaacatggcaaggaatagagagaggttggccaaaatcatcagttcgatggtttgtttttaatgtaatttttgtggaaactaatggggtttggctttgatttactggttttctttttcacttatgtactaggtttttgcttgctatgttatttcttgttttggttgtaaatatgctgttcgtttaagaaatcgggggttagtatgttatcgtgtgtataaaaatagtgtaagcacgtaagttgattacaaaaaaaaaaaaaaaaaaaaaaaaaaa

SEQ ID NO: 746 - protein, 175 aa, Arabidopsis thaliana
MEEEKRLELRLAPPCHQFTSNNNINGSKQKSSTKETSFLSNNRVEVAPVVGWPPVRSSRRNLTAQLKEEMKKKESDEEKELYVKINMEGVPIGRKVNLSAYNNYQQLSHAVDQLFSKKDSWDLNRQYTLVYEDTEGDKVLVGDVPWEMFVSTVKRLHVLKTSHAFSLSPRKHGKE

SEQ ID NO: 747 - DNA, 1707 bp, Arabidopsis thaliana
ccacgcgtccgcactctcccaaatctctcttctttaacaacaaaaaaaaaatcacagagacatagagagaagaagacggaacagaggctccaaaaaaatgatgatggagactagagatccagctattaagcttttcggtatgaaaatcccttttccgtcggtttttgaatcggcagttacggtggaggatgacgaagaagatgactggagcggcggagatgacaaatcaccagagaaggtaactccagagttatcagataagaacaacaacaactgtaacgacaacagttttaacaattcgaaacccgaaaccttggacaaagaggaagcgacatcaactgatcagatagagagtagtgacacgcctgaggataatcagcagacgacacctgatggtaaaaccctaaagaaaccgactaagattctaccgtgtccgagatgcaaaagcatggagaccaagttctgttattacaacaactacaacataaaccagcctcgtcatttctgcaaggcttgtcagagatattggactgctggagggactatgaggaatgttcctgtgggggcaggacgtcgtaagaacaaaagctcatcttctcattaccgtcacatcactatttccgaggctcttgaggctgcgaggcttgacccgggcttacaggcaaacacaagggtcttgagttttggtctcgaagctcagcagcagcacgttgctgctcccatgacacctgttatgaagctacaagaagatcaaaaggtctcaaacggtgctaggaacaggtttcacgggttagcggatcaacggcttgtagctcgggtagagaatggagatgattgctcaagcggatcctctgtgaccacctctaacaatcactcagtggatgaatcaagagcacaaagcggcagtgttgttgaagcacaaatgaacaacaacaacaacaataacatgaatggttatgcttgcatcccaggtgttccatggccttacacgtggaatccagcgatgcctccaccaggtttttacccgcctccagggtatccaatgccgttttacccttactggaccatcccaatgctaccaccgcatcaatcctcatcgcctataagccaaaagtgttcaaatacaaactctccgactctcggaaagcatccgagagatgaaggatcatcgaaaaaggacaatgagacagagcgaaaacagaaggccgggtgcgttctggtcccgaaaacgttgagaatagatgatcctaacgaagcagcaaagagctcgatatggacaacattgggaatcaagaacgaggcgatgtgcaaagccggtggtatgttcaaagggtttgatcataagacaaagatgtataacaacgacaaagctgagaactcccctgttctttctgctaaccctgctgctctatcaagatcacacaatttccatgaacagatttagagttacatatgtatatgtatatatgtatgattgattgtatgtatagatgatactggagaatgatgagtttttgagaatcaaactcttttcttctttctagtgattgcctttattcctttacatgttttggttctctgtacactatttgatttaccttttttactttctttcttcatttgtcaggaaatgttggaagataacattaatggtaaaaagttggtgtggaccgttgttgcgttggcatttcaaaaaaaaaaaaaaaa

SEQ ID NO: 748 - protein, 448 aa, Arabidopsis thaliana
MMMETRDPAIKLFGMKIPFPSVFESAVTVEDDEEDDWSGGDDKSPEKVTPELSDKNNNNCNDNSFNNSKPETLDKEEATSTDQIESSDTPEDNQQTTPDGKTLKKPTKILPCPRCKSMETKFCYYNNYNINQPRHFCKACQRYWTAGGTMRNVPVGAGRRKNKSSSSHYRHITISEALEAARLDPGLQANTRVLSFGLEAQQQHVAAPMTPVMKLQEDQKVSNGARNRFHGLADQRLVARVENGDDCSSGSSVTTSNNHSVDESRAQSGSVVEAQMNNNNNNNMNGYACIPGVPWPYTWNPAMPPPGFYPPPGYPMPFYPYWTIPMLPPHQSSSPISQKCSNTNSPTLGKHPRDEGSSKKDNETERKQKAGCVLVPKTLRIDDPNEAAKSSIWTTLGIKNEAMCKAGGMFKGFDHKTKMYNNDKAENSPVLSANPAALSRSHNFHEQI

SEQ ID NO: 749 - DNA, 660 bp, Arabidopsis thaliana
atgagaatgacaagagatggaaaagaacatgaatacaagaaaggtttatggacagtggaagaagacaagatcctcatggattatgtccgaactcatggccagggccactggaaccgcatcgccaagaaaactgggctcaagagatgtgggaaaagctgtaggttgagatggatgaactacttaagccctaatgttaacagaggcaattttactgaccaagaagaagatctcatcatcagactccacaagctcctcggcaacagatggtcgttgatagcgaaaagagttccgggaagaacagacaaccaagtaaagaattactggaacacacatctcagcaagaaacttggtctcggagatcattcaactgccgtcaaagccgcatgcggtgtagagtctccaccgtctatggcccttataaccacaacgtcctcctctcatcaagagatctccggtggaaaaaattcaactctaaggttcgacactttagttgacgaatccaaactcaaaccaaaatccaaactagtccacgcaacaccaactgacgtagaagttgcagctacggttccaaatctgttcgataccttttgggttcttgaagacgacttcgagcttagttcactcactatgatggattttactaatgggtattgcctttga

SEQ ID NO: 750 - protein, 219 aa, Arabidopsis thaliana
MRMTRDGKEHEYKKGLWTVEEDKILMDYVRTHGQGHWNRIAKKTGLKRCGKSCRLRWMNYLSPNVNRGNFTDQEEDLIIRLHKLLGNRWSLIAKRVPGRTDNQVKNYWNTHLSKKLGLGDHSTAVKAACGVESPPSMALITTTSSSHQEISGGKNSTLRFDTLVDESKLKPKSKLVHATPTDVEVAATVPNLFDTFWVLEDDFELSSLTMMDFTNGYCL

SEQ ID NO: 751 - DNA, 2299 bp, Arabidopsis thaliana
ctctcaaacatttctctgtttgttccggcgaaaacggcaactgtttcatcaaatgacaaacacaaaaaccttaacatctagtttgtatcctctctgatacttcaaaaaaaatggatgaagaaacaatggctaccggacaaaacagaacaactgtgccagagaatctgaagaaacacctcgcagtttcagttcgaaacattcaatggagttatggtatcttttggtctgtctctgcttctcagtctggagttttagaatggggagatggatactataatggagatatcaaaacgaggaagacgattcaagcttcggagatcaaagctgatcagcttggtctacggaggagcgagcagcttagcgagctttacgagtctctctccgtcgctgaatcttcttcttcaggcgttgctgccggatctcaagtcaccagacgagcttccgccgccgcactttcaccggaagatctcgccgacaccgagtggtactatttggtttgtatgtctttcgtcttcaacattggtgaaggaatgcctggacggacgtttgcaaacggtgaaccgatatggttgtgcaacgctcatacggcggatagtaaagtgtttagccgttctcttctagcaaaaagtgctgcggttaagacagtggtttgcttcccgttccttggaggagtcgttgagattggtaccacagaacatattacggaagacatgaatgtaatacaatgcgtgaagacatcattcctcgaagcccctgatccgtacgctacaatattaccagcaagatccgattatcacatcgacaacgttcttgatccgcaacagattctaggcgacgagatttacgcgcctatgttcagtacggagccttttccaacagcttctccgagcagaactaccaacggtttcgatcaagaacatgaacaagtagcagatgatcatgattctttcatgaccgaaagaatcactggaggagcttctcaggtgcaaagctggcagctcatggacgacgagcttagtaactgcgttcaccagtcgctaaattccagcgattgcgtctctcaaacgtttgttgaaggggcggctggacgggttgcttacggtgcaagaaagagtagagttcaaagactagggcaaattcaagagcaacagagaaatgtgaagacattgtcatttgatccaagaaacgacgacgttcattaccaaagtgtgatctcaacgatttttaagaccaaccatcagttaattctcggaccgcagtttcgaaactgcgataaacagtcaagcttcactaggtggaagaaatcatcgtcatcatcatcaggaaccgccacggtcacggcaccatcacaaggaatgttaaagaaaattattttcgatgttccgcgagtgcaccagaaagagaagttaatgttggactcaccagaagccagagatgaaactgggaaccatgcggttttagagaagaagcgccgcgagaaattgaacgaacggttcatgaccttgagaaaaatcattccgtcaatcaacaagatcgataaagtatcgattcttgacgatacgatagagtatcttcaagaactcgagagacgggttcaagaactagaatcttgcagagaatcaaccgatacagagactcgtgggacgatgacgatgaagaggaagaaaccatgcgacgcaggagaaagaacatcagctaattgcgcaaataatgaaacaggaaatgggaagaaggtgtcggttaacaatgttggtgaagccgagccagcagataccggttttactggtttaaccgataatttaaggatcggttcgtttggtaatgaggtggttattgagcttagatgtgcttggagagaaggagtattgcttgagataatggatgtgattagtgatctccatttggattctcattcggttcaatcctcgaccggagacggtttgctctgcttaaccgtcaattgcaagcacaaggggtcaaaaatagcgacaccaggaatgatcaaagaagcacttcaaagggttgcatggatctgttgaagactacttagttaaaattgacagcaaagaaaaaacattcccggtttggtttctattctttggttttcttctaaccgggttttaggaattaatgttatgtttatcatttgttttttgttttttttttgtgtctttttttccgttgcttaacgtaggtgaagaggaacatacactatgcgtattttgtttgaggtagattattttaagggtattagtaatagtaatagccagtttagatgattttgtgttcttttgttgtt

SEQ ID NO: 752 - protein, 642 aa, Arabidopsis thaliana
MDEETMATGQNRTTVPENLKKHLAVSVRNIQWSYGIFWSVSASQSGVLEWGDGYYNGDIKTRKTIQASEIKADQLGLRRSEQLSELYESLSVAESSSSGVAAGSQVTRRASAAALSPEDLADTEWYYLVCMSFVFNIGEGMPGRTFANGEPIWLCNAHTADSKVFSRSLLAKSAAVKTVVCFPFLGGVVEIGTTEHITEDMNVIQCVKTSFLEAPDPYATILPARSDYHIDNVLDPQQILGDEIYAPMFSTEPFPTASPSRTTNGFDQEHEQVADDHDSFMTERITGGASQVQSWQLMDDELSNCVHQSLNSSDCVSQTFVEGAAGRVAYGARKSRVQRLGQIQEQQRNVKTLSFDPRNDDVHYQSVISTIFKTNHQLILGPQFRNCDKQSSFTRWKKSSSSSSGTATVTAPSQGMLKKIIFDVPRVHQKEKLMLDSPEARDETGNHAVLEKKRREKLNERFMTLRKIIPSINKIDKVSILDDTIEYLQELERRVQELESCRESTDTETRGTMTMKRKKPCDAGERTSANCANNETGNGKKVSVNNVGEAEPADTGFTGLTDNLRIGSFGNEVVIELRCAWREGVLLEIMDVISDLHLDSHSVQSSTGDGLLCLTVNCKHKGSKIATPGMIKEALQRVAWIC

SEQ ID NO: 753 - DNA, 798 bp, Arabidopsis thaliana
atggagcaaggaggaggtggtggtggtaatgaagttgtggaggaagcttcacctattagttcaagacctcctgctaacaacttagaagagcttatgagattctcagccgccgcggatgacggtggattaggaggtggaggtggaggaggaggaggaggaagtgcttcttcttcatcgggaaatcgatggccgagagaagaaactttagctcttcttcggatccgatccgatatggattctacttttcgtgatgctactctcaaagctcctctttgggaacatgtttccaggaagctattggagttaggttacaaacgaagttcaaagaaatgcaaagagaaattcgaaaacgttcagaaatattacaaacgtactaaagaaactcgcggtggtcgtcatgatggtaaagcttacaagttcttctctcagcttgaagctctcaacactactcctcctcctcctccttctcatcctcacgctcatcaaccagaacagaaacaacaacaacaaccacaacaagagatggtcatgagctcggaacaatcatcattaccatcatcatcaagatggccaaaggcagagattctagcgcttataaacctgagaagtggaatggaaccaaggtaccaagataatgtacctaaaggacttctatgggaagagatctcaacttcaatgaagagaatgggatacaacagaaacgctaagagatgtaaagagaaatgggaaaacataaacaaatactacaagaaagttaaagaaagcaacaacagcaactacaacaacaagaatcaatga

SEQ ID NO: 754 - protein, 265 aa, Arabidopsis thaliana
MEQGGGGGGNEVVEEASPISSRPPANNLEELMRFSAAADDGGLGGGGGGGGGGSASSSSGNRWPREETLALLRIRSDMDSTFRDATLKAPLWEHVSRKLLELGYKRSSKKCKEKFENVQKYYKRTKETRGGRHDGKAYKFFSQLEALNTTPPPPPSHPHAHQPEQKQQQQPQQEMVMSSEQSSLPSSSRWPKAEILALINLRSGMEPRYQDNVPKGLLWEEISTSMKRMGYNRNAKRCKEKWENINKYYKKVKESNNSNYNNKNQ

SEQ ID NO: 755 - DNA, 612 bp, Arabidopsis thaliana
atgagaaagaaagtaagtagtagtggtgacgaaggaaacaatgagtacaagaaaggtttgtggacagtagaagaagacaaaatcctcatggattatgtcaaagctcatggcaaaggtcactggaatcgtattgccaaaaagactggtttaaagagatgtggaaagagttgtagattgaggtggatgaattatctcagccctaatgtgaaaagaggcaatttcaccgagcaagaagaggatcttatcattaggctccacaagttgcttggtaataggtggtctttaattgctaaaagagtgccgggtcgaacggataatcaagtgaagaactattggaacacgcatcttagtaagaaactcggaatcaaagatcagaaaaccaaacagagcaatggtgatattgtttatcaaatcaatctcccgaatcctaccgaaacatcagaagaaacgaaaatctcgaatattgtcgataacaataatatcctcggagatgaaattcaagaagatcatcaaggaagtaactacttgagttcactttgggttcatgaggatgagtttgagcttagcacactcaccaacatgatggactttatagatggacactgtttttga

SEQ ID NO: 756 - protein, 203 aa, Arabidopsis thaliana
MRKKVSSSGDEGNNEYKKGLWTVEEDKILMDYVKAHGKGHWNRIAKKTGLKRCGKSCRLRWMNYLSPNVKRGNFTEQEEDLIIRLHKLLGNRWSLIAKRVPGRTDNQVKNYWNTHLSKKLGIKDQKTKQSNGDIVYQINLPNPTETSEETKISNIVDNNNILGDEIQEDHQGSNYLSSLWVHEDEFELSTLTNMMDFIDGHCF

SEQ ID NO: 757 - DNA, 228 bp, Arabidopsis thaliana
atggataaccatcgcaggactaagcaacccaagaccaactccatcgttacttcttcttctgaagaagtgagtagtcttgagtgggaagttgtgaacatgagtcaagaagaagaagatttggtctctcgaatgcataagcttgtcggtgacaggtgggaactgatagctgggaggatcccaggaagaaccgctggagaaattgagaggttttgggtcatgaaaaattga

SEQ ID NO: 758 - protein, 75 aa, Arabidopsis thaliana
MDNHRRTKQPKTNSIVTSSSEEVSSLEWEVVNMSQEEEDLVSRMHKLVGDRWELIAGRIPGRTAGEIERFWVMKN

SEQ ID NO: 759 - DNA, 993 bp, Arabidopsis thaliana
atggagatcatgcgtccaggggtctcagaaaacactttgaaaggaaaaataagaatcacaacgcggtgcatgtggcttgacaaaggaagacttttagatgcacttcacaaagcagctcatgctgctctatcaagttgtcctgtgacatgtcccttgtctcacatggaaagaacagtctccgaagtcctgaggaagattgtaaggaagtacagtggtaaaaggcctgaagtcatcgctatagccactgagaatccaatggctgtccgagctgatgaggtcagtgcgagactgtctggtgatccaagtgttggttctggagttgcagctttaaggaaagttgttgaaggaaatgacaaaagaagtcgggcgaagaaagcaccttcacaagaagcttcccccaaagaagtagatcgcactttggaagatgatatcattgatagtgcaagactactggctgaagaagaaactgcggcatcaacatacacggaagaagttgatacgcccgttgggagttcttcagaagagtcagacgatttttggaaatcattcatcaatccatcatcgtcaccttcaccgagtgaaacagaaaatatgaataaggtagctgatacggagcctaaagcagagggtaaggaaaacagcagagacgacgatgaattagctgatgcttcagattctgaaaccaagtcatcaccaaaacgtgtgaggaagaacaaatggaaaccggaggagataaagaaggtaatcagaatgcgaggagagctgcacagtagatttcaagtggtgaaaggtagaatggcattgtgggaagagatctcttcaaatctatcagctgaaggaatcaatcgaagcccgggacaatgcaaatctctctgggcatcacttattcagaaatacgaggagagcaaggctgatgagagaagcaagacgagttggccacattttgaggatatgaacaacattttgtcagagctaggcacacctgcgtcttaa

SEQ ID NO: 760 - protein, 330 aa, Arabidopsis thaliana
MEIMRPGVSENTLKGKIRITTRCMWLDKGRLLDALHKAAHAALSSCPVTCPLSHMERTVSEVLRKIVRKYSGKRPEVIAIATENPMAVRADEVSARLSGDPSVGSGVAALRKVVEGNDKRSRAKKAPSQEASPKEVDRTLEDDIIDSARLLAEEETAASTYTEEVDTPVGSSSEESDDFWKSFINPSSSPSPSETENMNKVADTEPKAEGKENSRDDDELADASDSETKSSPKRVRKNKWKPEEIKKVIRMRGELHSRFQVVKGRMALWEEISSNLSAEGINRSPGQCKSLWASLIQKYEESKADERSKTSWPHFEDMNNILSELGTPAS

SEQ ID NO: 761 - DNA, 1606 bp, Arabidopsis thaliana
gagagttgttagctagctcacacgctttcgcttaaaactcaaaaacctgcactttctcgtctattttctcggcattcgtaaaacagaaaagtgggtctccaagaaaattaccctaaattcacaaagattcatacttttctccacctccaatggattccagagagatccaccaccaacaacagcaacaacaacaacaacaacagcagcagcagcaacaacagcaacatctacaacaacagcaacaaccaccgccagggatgttaatgagtcaccacaattcctacaatcgaaaccctaacgccgccgccgctgttttaatgggtcacaacacctccacatctcaagctatgcatcaaagattaccttttggtggttctatgtcaccgcatcagcctcaacaacatcagtatcatcatcctcagcctcagcaacagatagatcagaagactcttgaatctcttggatttcctacttcgcctcttccttctgcttctaattcttacggtggtggaaatgaaggaggtggtggtggtgatagcgccggagctaatgctaactcttccgatccacctgctaaacggaacagaggacgtcctcctggctccggtaagaagcagctcgatgctttaggaggaacaggaggagttgggttcacgcctcatgtcattgaggttaaaacaggagaggacatagctacgaagatattggcgtttacgaaccaagggccacgcgcaatctgtattctctcagctacaggagctgtaactaatgtgatgcttcgtcaagctaacaatagcaatcctactggaactgttaagtatgagggccgatttgaaatcatttctctgtcaggttctttcttgaattctgagagtaatggtactgtgaccaaaactggtaacttgagtgtgtcgctggctggacacgaaggccggattgtgggtggatgtgttgatggaatgctagtagctggatcacaagtccaggtcattgtgggaagctttgtaccagatggaaggaagcagaaacaaagtgcggggcgtgctcagaatactccggagccagcttcagcaccagccaatatgttgagctttggtggtgttggtggaccgggaagccctcgatctcaaggacaacaacactcgagcgagtcatcagaggaaaacgaaagtaattctccgttgcaccgtagaagcaacaacaacaacagcaacaatcatgggatatttggaaactctacacctcaaccgcttcaccaaattcctatgcagatgtaccagaatctctggcctggcaacagtcctcaataaacagatggttcatgggtcaagatttgaccgggtttgcttctctgttccttttgacacatctctccatcagatttatctctataaagtagattgagctctcttactctctcatcttcttctcctttactatttctcttaaatttagctttggttttagataaatagagagagagagacatgttaagtaggtttcaaattcaatcttgtttagtttgtttcttagtagtttcttttgattgtgatgatcataaagacttgttctttttctcctatattcaacgaattatccactttaa

SEQ ID NO: 762 - protein, 386 aa, Arabidopsis thaliana
MDSREIHHQQQQQQQQQQQQQQQQQHLQQQQQPPPGMLMSHHNSYNRNPNAAAAVLMGHNTSTSQAMHQRLPFGGSMSPHQPQQHQYHHPQPQQQIDQKTLESLGFPTSPLPSASNSYGGGNEGGGGGDSAGANANSSDPPAKRNRGRPPGSGKKQLDALGGTGGVGFTPHVIEVKTGEDIATKILAFTNQGPRAICILSATGAVTNVMLRQANNSNPTGTVKYEGRFEIISLSGSFLNSESNGTVTKTGNLSVSLAGHEGRIVGGCVDGMLVAGSQVQVIVGSFVPDGRKQKQSAGRAQNTPEPASAPANMLSFGGVGGPGSPRSQGQQHSSESSEENESNSPLHRRSNNNNSNNHGIFGNSTPQPLHQIPMQMYQNLWPGNSPQ

SEQ ID NO: 763 - DNA, 1056 bp, Arabidopsis thaliana
atgactctagaagctttatcatcaaacggtcttttaaactttttgctctctgaaactctttcaccaactccattcaagtctctcgtcgatctcgagccattgccggaaaatgatgtcatcatatcgaagaacacaatttcggagatatctaatcaagaaccgccaccacagcgacaaccaccagctacgaatcgagggaagaagcggcggaggaggaagcctagggtttgcaaaaacgaggaagaagctgagaatcaacgaatgactcacattgccgtcgaaagaaatcgaagaagacaaatgaatcaacatctctctgtcttgcgatctctcatgcctcaaccttttgctcacaagggtgatcaagcttcaatagttggtggagccatagatttcatcaaagaacttgaacacaaattactatctcttgaagctcaaaaacatcataatgctaaattaaaccagtcggttacttcttcaacaagtcaagactcaaatggtgaacaagagaatcctcatcaaccatcttcactatctctatcgcagttctttcttcattcatacgatccgagccaagagaataggaacggctcaacaagctcggtgaaaacccctatggaagatcttgaggtgactctaatcgaaactcatgctaacatcagaatcttgtcgagaagaagaggtttccggtggagcacgttggccaccaccaaaccgccgcagctttcgaagctggtggcttctctacaatcgctgtccctctccattcttcaccttagtgtcacaacattggacaattatgctatttactccatcagcgctaaggtggaagagagttgccagctaagttcagtagatgacattgcaggagcagttcaccacatgctaagtatcattgaagaggagcctttttgttgctcatcaatgtcagaattaccatttgacttctctttgaatcactcaaatgtcactcattctctctgagaaatctcttttttgttgttgttattccttcttttaattttatcacatagcacatctttagttttttttttt

SEQ ID NO: 764 - protein, 327 aa, Arabidopsis thaliana
MTLEALSSNGLLNFLLSETLSPTPFKSLVDLEPLPENDVIISKNTISEISNQEPPPQRQPPATNRGKKRRRRKPRVCKNEEEAENQRMTHIAVERNRRRQMNQHLSVLRSLMPQPFAHKGDQASIVGGAIDFIKELEHKLLSLEAQKHHNAKLNQSVTSSTSQDSNGEQENPHQPSSLSLSQFFLHSYDPSQENRNGSTSSVKTPMEDLEVTLIETHANIRILSRRRGFRWSTLATTKPPQLSKLVASLQSLSLSILHLSVTTLDNYAIYSISAKVEESCQLSSVDDIAGAVHHMLSIIEEEPFCCSSMSELPFDFSLNHSNVTHSL

SEQ ID NO: 765 - DNA, 1630 bp, Arabidopsis thaliana
aatggatttgtcatcattcttctcaccgtccttagtctctgaaaataaattctgattttgatttcgaattttagggattttgagagagagtcagttatgagtagttcggagagagtaccgtgcgatttctgcggcgagcgtacggcggttttgttttgtagagccgatacggcgaagctgtgtttgccttgtgatcagcaagttcacacggcgaatctgttgtcgaggaagcacgtgcgatctcagatctgcgataattgcggtaacgagccagtctctgttcggtgtttcaccgataatctgattttgtgtcaggagtgtgattgggatgttcacggaagttgttcagtttccgatgctcatgttcgatccgccgtggaaggtttttccggttgtccatcggcgttggagcttgctgctttatggggacttgatttggagcaagggaggaaagatgaagagaatcaagttccgatgatggcgatgatgatggataatttcgggatgcagttggattcttgggttttgggatctaatgaattgattgttcccagcgatacgacgtttaagaagcgtggatcttgtggatctagttgtgggaggtataagcaggtattgtgtaagcagcttgaggagttgcttaagagtggtgttgtcggtggtgatggcgatgatggtgatcgtgaccgtgattgtgaccgtgagggtgcttgtgatggagatggagatggagaagcaggagaggggcttatggttccggagatgtcagagagattgaaatggtcaagagatgttgaggagatcaatggtggcggaggaggaggagttaaccagcagtggaatgctactactactaatcctagtggtggccagagttctcagatatgggattttaacttgggacagtcacggggacctgaggatacgagtcgagtggaagctgcatatgtagggaaaggtgctgcttcttcattcacaatcaacaattttgttgaccatatgaatgaaacttgttccactaatgtgaaaggtgtcaaagagattaaaaaggatgactacaagcgatcaacttcaggccaggtacaaccaacaaaatctgagagcaacaatcgtccaattacctttggctctgagaaaggttcgaactcctccagtgacttgcatttcacagagcatattgctggaactagttgtaagaccacaagactagttgcaactaaggctgatctggagcggctggctcagaacagaggagatgcaatgcagcgttacaaggaaaagaggaagacacggagatatgataagaccataaggtatgaatcgaggaaggcaagagctgacactaggttgcgtgtcagaggcagatttgtgaaagctagtgaagctccttacccttaaccttaagttttttcacataggcttccttttagctacaaacttagttactttttttactccactgcctcataaatgtacagaccggtctcgtttcatctggccgcccttcttgttttattgccttatctggcccttttatgtaccttggaatcttatctagtttaaaaaagattgtaaccttctagaaaaccatattctgttgacagtatatacatgtctatccaagcaaaaa

SEQ ID NO: 766 - protein, 433 aa, Arabidopsis thaliana
MSSSERVPCDFCGERTAVLFCRADTAKLCLPCDQQVHTANLLSRKHVRSQICDNCGNEPVSVRCFTDNLILCQECDWDVHGSCSVSDAHVRSAVEGFSGCPSALELAALWGLDLEQGRKDEENQVPMMAMMMDNFGMQLDSWVLGSNELIVPSDTTFKKRGSCGSSCGRYKQVLCKQLEELLKSGVVGGDGDDGDRDRDCDREGACDGDGDGEAGEGLMVPEMSERLKWSRDVEEINGGGGGGVNQQWNATTTNPSGGQSSQIWDFNLGQSRGPEDTSRVEAAYVGKGAASSFTINNFVDHMNETCSTNVKGVKEIKKDDYKRSTSGQVQPTKSESNNRPITFGSEKGSNSSSDLHFTEHIAGTSCKTTRLVATKADLERLAQNRGDAMQRYKEKRKTRRYDKTIRYESRKARADTRLRVRGRFVKASEAPYP

SEQ ID NO: 767 - DNA, 943 bp, Arabidopsis thaliana
cgagaaaaggaaaaaaaaaaatagaaagagaaaacgcttagtatctccggcgacttgaacccaaacctgaggatcaaattagggcacaaagccctctcggagagaagccatgggaagaaaaaaactagaaatcaagcgaattgagaacaaaagtagccgacaagtcaccttctccaaacgtcgcaacggtctcatcgagaaagctcgtcagctttctgttctctgtgacgcatccgtcgctcttctcgtcgtctccgcctccggcaagctctacagcttctcctccggcgataacctggtcaagatccttgatcgatatgggaaacagcatgctgatgatcttaaagccttggatcatcagtcaaaagctctgaactatggttcacactatgagctacttgaacttgtggatagcaagcttgtgggatcaaatgtcaaaaatgtgagtatcgatgctcttgttcaactggaggaacaccttgagactgccctctccgtgactagagccaagaagaccgaactcatgttgaagcttgttgagaatcttaaagaaaaggagaaaatgctgaaagaagagaaccaggttttggctagccagatggagaataatcatcatgtgggagcagaagctgagatggagatgtcacctgctggacaaatctccgacaatcttccggtgactctcccactacttaattagccaccttaaatcggcggttgaaatcaaaatccaaaacatatataattatgaagaaaaaaaaaataagatatgtaattattccgctgataagggcgagcgtttgtatatcttaatactctctctttggccaagagactttgtgtgtgatacttaagtagacggaactaagtcaatactatctgttttaagacaaaaggttgatgaactttgtaccttattcgtgtgagaaaaaaaaaaaaaaaa

SEQ ID NO: 768 - protein, 196 aa, Arabidopsis thaliana
MGRKKLEIKRIENKSSRQVTFSKRRNGLIEKARQLSVLCDASVALLVVSASGKLYSFSSGDNLVKILDRYGKQHADDLKALDHQSKALNYGSHYELLELVDSKLVGSNVKNVSIDALVQLEEHLETALSVTRAKKTELMLKLVENLKEKEKMLKEENQVLASQMENNHHVGAEAEMEMSPAGQISDNLPVTLPLLN

SEQ ID NO: 769 - DNA, 1716 bp, Arabidopsis thaliana
tatctctctctttctcaaaacctttcagtcaaaattctccggcggcttttaaactatgtgaaggaggagaacctccataacaagaagcggattctctcagttttccggcggcggaggaacacaaagccaccggtttttagacacacagatttcattttcagttgttaaatggtaactagagaaacgaagttgacgtcagagcgagaagtagagtcgtccatggcgcaagcgagacataatggaggaggtggtggtgagaatcatccgtttacttctttgggaagacaatcctctatctactcattgacccttgacgagttccaacatgctttatgtgagaacggcaagaactttgggtccatgaacatggacgagtttcttgtctctatttggaacgcagaggagaataataacaatcaacaacaagcagcagcagctgcaggttcacattctgttccggctaatcacaatggtttcaacaacaacaataacaatggaggcgagggtggtgttggtgtctttagtggtggttctagaggcaacgaagatgctaacaataagagagggatagcgaacgagtctagtcttcctcgacaaggctctttgacacttccagctccgctttgtaggaagactgttgatgaggtttggtctgagatacatagaggtggtggtagcggtaatggaggagacagcaatggacgtagtagtagtagtaatggacagaacaatgctcagaacggcggtgagactgcggctagacaaccgacttttggagagatgacacttgaggatttcttggtgaaggctggtgtggttagagaacatcccactaatcctaaacctaatccaaacccgaaccaaaaccaaaacccgtctagtgtaatacccgcagctgcacagcaacagctttatggtgtgtttcaaggaaccggtgatccttcattcccgggtcaagctatgggtgtgggtgacccatcaggttatgctaaaaggacaggaggaggagggtatcagcaggcgccaccagttcaggcaggtgtttgctatggaggtggcgttgggtttggagcgggtggacagcaaatgggaatggttggaccgttaagcccggtgtcttcagatggattaggacatggacaagtggataacataggaggtcagtatggagtagatatgggagggctaaggggaaggaaaagagtagtggatggtccagtggagaaagtagtggagagaagacagaggaggatgatcaagaaccgcgagtctgctgctagatctagagcaagaaaacaagcatatacagtggaattggaagctgaacttaaccagttgaaagaagagaatgcgcagctaaaacatgcattggcggagttggagaggaagaggaagcaacagtattttgagagtttgaagtcaagggcacaaccgaaattgccgaaatcgaacgggagattgcggacattgatgaggaacccgagttgtccactctaaacaaacaataggaagatggagaagaagtcggagacagaacgagggaaaaactgatgattttctacgttgttgttttgtctttgaggaatgaggttatagaatctttatactttgatgttttctgtgttggtaggaggaacaccatctgatctgctttactagtgttccctgtgaacaaagaaagtgattctgtgtttcaacatcatcaatctttggaaa

SEQ ID NO: 770 - protein, 442 aa, Arabidopsis thaliana
MVTRETKLTSEREVESSMAQARHNGGGGGENHPFTSLGRQSSIYSLTLDEFQHALCENGKNFGSMNMDEFLVSIWNAEENNNNQQQAAAAAGSHSVPANHNGFNNNNNNGGEGGVGVFSGGSRGNEDANNKRGIANESSLPRQGSLTLPAPLCRKTVDEVWSEIHRGGGSGNGGDSNGRSSSSNGQNNAQNGGETAARQPTFGEMTLEDFLVKAGVVREHPTNPKPNPNPNQNQNPSSVIPAAAQQQLYGVFQGTGDPSFPGQAMGVGDPSGYAKRTGGGGYQQAPPVQAGVCYGGGVGFGAGGQQMGMVGPLSPVSSDGLGHGQVDNIGGQYGVDMGGLRGRKRVVDGPVEKVVERRQRRMIKNRESAARSRARKQAYTVELEAELNQLKEENAQLKHALAELERKRKQQYFESLKSRAQPKLPKSNGRLRTLMRNPSCPL

SEQ ID NO: 771 - DNA, 1107 bp, Arabidopsis thaliana
aaaagatctgtttcaatggcggatcgtgttaaaggtccatggagtcaagaagaagatgagcagctacgaaggatggttgagaaatacggaccgaggaattggtctgcgattagcaaatcgattccaggtcgatctggtaaatcgtgtagattacgttggtgtaatcagttatctccggaggttgagcatcgtcctttctcgccggaggaagatgagactattgtaaccgcccgtgctcagtttggtaacaagtgggcgacgattgctcgtcttcttaacggtcgtacggataacgccgttaaaaatcactggaactctacgcttaagaggaaatgcagcggaggtgtggcggttacgacggtgacggagacggaggaagatcaggatcggccgaagaagaggagatctgttagctttgatcctgcttttgctccggtggatactggattgtacatgagtcctgagagtcctaacggaatcgatgttagtgattctagcacgattccgtcaccgtcgtctcctgttgctcagctgtttaaaccaatgccgatttccggcggttttacggtggttccgcagccgttaccggttgaaatgtcttcgtcttcggaggatccacctacttcgttgagtttgtcactacctggagctgagaacacgagttcgagccataacaataacaacaacgcgttgatgtttccgagatttgagagtcagatgaagattaatgtagaggagagaggaggaggaggagaaggacgtagaggtgagtttatgacggtggtgcaggagatgataaaagctgaagtgaggagttacatggcggaaatgcagaaaacaagtggtggattcgtcgtcggaggtttatacgaatccggcggcaatggtggttttagggattgtggagtaataacacctaaggttgagtagttttggtttagggttaaaacttgaatcgattggggattttcaagagcattcatttttggggtttatggtaaaattaaaaacaaaaacaaaatgtacagaggaattaaaatttctatggaataatcttaaatctcaaatatttgttacttgttttggtgattcataaccaaaatcaaa

SEQ ID NO: 772 - protein, 304 aa, Arabidopsis thaliana
MADRVKGPWSQEEDEQLRRMVEKYGPRNWSAISKSIPGRSGKSCRLRWCNQLSPEVEHRPFSPEEDETIVTARAQFGNKWATIARLLNGRTDNAVKNHWNSTLKRKCSGGVAVTTVTETEEDQDRPKKRRSVSFDPAFAPVDTGLYMSPESPNGIDVSDSSTIPSPSSPVAQLFKPMPISGGFTVVPQPLPVEMSSSSEDPPTSLSLSLPGAENTSSSHNNNNNALMFPRFESQMKINVEERGGGGEGRRGEFMTVVQEMIKAEVRSYMAEMQKTSGGFVVGGLYESGGNGGFRDCGVITPKVE

SEQ ID NO: 773 - DNA, 1182 bp, Arabidopsis thaliana
atggaggcagagatcgtgagacgatcggaggtaacgggattaagaagggaggtggaagaatcgtcaattggtagaggagattgcgatggtgatggcggcgatgtgggagaagatgcggcagggttcgttgggacgagcgggagaggaagaagagatcgagttaaagggccgtggtcgaaggaggaggatgatgtgttgagtgagctcgttaagaggttgggagcgaggaattggagttttatcgctcggagtattcctggtcgttcaggcaagtcttgtcgtcttcgttggtgtaatcagctcaatccaaatcttatacgcaattcatttactgaggtagaggatcaggctatcatcgcagcacatgccatccacggaaacaaatgggctgttatcgcgaagctcctccccggaagaacagataatgctatcaagaaccactggaactctgctttaagacgtcgattcatagactttgaaaaggccaagaatataggaactggaagcttggtcgtggatgattctggatttgacagaacgacaacagtagcctcatcagaagaaactttatcttcaggcggtggttgccatgtaactactccaattgtatctccagaaggcaaagaagctaccacctccatggaaatgtctgaagaacaatgcgtagagaaaacaaacggagaaggtatttctaggcaagatgataaggatcctccaacgcttttccgcccagtgcctcggctcagttcttttaatgcttgcaatcacatggaaggatcaccctctccacatatacaagaccaaaatcagctccaatcatctaaacaagacgcagcaatgctaagattgcttgaaggagcttacagcgaacggtttgtgcctcaaacatgtggaggtggttgttgcagcaacaatcccgatggcagttttcagcaagaatcattgttgggtccagagtttgtggattacttagactcaccaacgtttccgagttccgaactagctgctatagcaacggaaataggcagcctcgcttggctgagaagcggtttagagagtagcagcgtgagggtgatggaagacgcagttggtcggttaaggcctcaaggctccaggggtcatcgagatcattatcttgtatctgaacaggggacgaacataaccaatgtcctgtccacataa

SEQ ID NO: 774 - protein, 393 aa, Arabidopsis thaliana
MEAEIVRRSEVTGLRREVEESSIGRGDCDGDGGDVGEDAAGFVGTSGRGRRDRVKGPWSKEEDDVLSELVKRLGARNWSFIARSIPGRSGKSCRLRWCNQLNPNLIRNSFTEVEDQAIIAAHAIHGNKWAVIAKLLPGRTDNAIKNHWNSALRRRFIDFEKAKNIGTGSLVVDDSGFDRTTTVASSEETLSSGGGCHVTTPIVSPEGKEATTSMEMSEEQCVEKTNGEGISRQDDKDPPTLFRPVPRLSSFNACNHMEGSPSPHIQDQNQLQSSKQDAAMLRLLEGAYSERFVPQTCGGGCCSNNPDGSFQQESLLGPEFVDYLDSPTFPSSELAAIATEIGSLAWLRSGLESSSVRVMEDAVGRLRPQGSRGHRDHYLVSEQGTNITNVLST

SEQ ID NO: 775 - DNA, 1046 bp, Arabidopsis thaliana
gaaaaacatttcaacttcttttatcagcaatcacaaatcaaagagatgggaagagctccatgctgtgagaagatggggttgaagagaggaccatggacacctgaagaagatcaaatcttggtctcttttatcctcaaccatggacatagtaactggcgagccctccctaagcaagctggtcttttgagatgtggaaaaagctgtagacttaggtggatgaactatttaaagcctgatattaaacgtggcaatttcaccaaagaagaggaagatgctatcatcagcttacaccaaatacttggcaatagatggtcagcgattgcagcaaaactgcctggaagaaccgataacgagatcaagaacgtatggcacactcacttgaagaagagactcgaagattatcaaccagctaaacctaagaccagcaacaaaaagaagggtactaaaccaaaatctgaatccgtaataacgagctcgaacagtactagaagcgaatcggagctagcagattcatcaaacccttctggagaaagcttattttcgacatcgccttcgacaagtgaggtttcttcgatgacactcataagccacgacggctatagcaacgagattaatatggataacaaaccgggagatatcagtactatcgatcaagaatgtgtttctttcgaaacttttggtgcggatatcgatgaaagcttctggaaagagacactgtatagccaagatgaacacaactacgtatcgaatgacctagaagtcgctggtttagttgagatacaacaagagtttcaaaacttgggctccgctaataatgagatgatttttgacagtgagatggaacttctggttcgatgtattggctagaaccggcggggaacaagatctcttagccgggctctagttaacatgtttgaggagtaaagtgaaatggtgcaaattagttaaggctaagaaattcaaaagcttttgtttaccgagaaaaaaacacactctaactcttgatgtgatgtagttagtgtattaattagaggctgcgttttcaa

SEQ ID NO: 776 - protein, 273 aa, Arabidopsis thaliana
MGRAPCCEKMGLKRGPWTPEEDQILVSFILNHGHSNWRALPKQAGLLRCGKSCRLRWMNYLKPDIKRGNFTKEEEDAIISLHQILGNRWSAIAAKLPGRTDNEIKNVWHTHLKKRLEDYQPAKPKTSNKKKGTKPKSESVITSSNSTRSESELADSSNPSGESLFSTSPSTSEVSSMTLISHDGYSNEINMDNKPGDISTIDQECVSFETFGADIDESFWKETLYSQDEHNYVSNDLEVAGLVEIQQEFQNLGSANNEMIFDSEMELLVRCIG

SEQ ID NO: 777 - DNA, 1391 bp, Arabidopsis thaliana
cgatttcgagctctatggtgtccgtaaaccctagacctaagggttttccagttttcgattcctcgaatatgagtttaccaagctccgatggatttggttcgattccggccacgggacggaccagtacggtgtcgttttctgaggatccgacgacgaagattcggaagccgtacacaatcaagaagtcgagagagaattggacagatcaagagcacgataaatttctagaagctcttcacttattcgatagggattggaagaaaatagaagcctttgttggatcaaaaacagtagttcagatacgaagccacgctcagaaatactttctcaaagttcagaagagtggtgctaacgaacatcttccacttcctcgacctaagaggaaagcgagtcatccttatcctataaaggctcctaaaaatgttgcttatacctctctcccgtcttcgagtacattaccgttgcttgagcctggttatttgtatagctctgattcgaagtcattgatgggaaaccaggctgtttgtgcatctacctcttcttcgtggaatcatgaatcgacaaatctgccaaaaccggtgattgaagaggaaccgggagtctcggccacggctcctctcccaaataatcgctgcagacaggaagatacagagagggtacgagcagtgacaaagccaaataacgaagaaagttgtgaaaagccacatagagtgatgccgaattttgctgaagtttacagcttcattggaagtgtcttcgatcccaacacatcaggccacctccagagattaaagcagatggatccaataaatatggaaacggttcttttactgatgcaaaacctgtctgtaaatctgacaagtcccgagtttgcagagcaaaggaggttgatatcatcatacagcgctaaagctttgaaatagagatagaataaaacaataatgtaccttatgtgagatcaagagacaatcatccaaggtctgtatgcattgcttggatttaggcctcgtgttctcactacaggagcagaaccaatcgcaaagactcttagatggctactgagttgtggtttttatgtctctgtaagtcgcggtggagcacacgtgtttgtcctgtcttgtgtatgtgtgtatagataatacaaggttttgcagagtaaggtcacagttagctgcaagtgagtttggatcaatcttaagattaaaaccctgagagtgagtgtccaaagagactgtgtaatattggtttggcggtcagcagaagagttttgaagtgcacatccagttagtgataacacggttgaagaaaaggtaaggttacaagtttagttttgaataattgtatactcaaaaaatatgaatgtataaagaataatcacttgagtcgcctta

SEQ ID NO: 778 - protein, 302 aa, Arabidopsis thaliana
MVSVNPRPKGFPVFDSSNMSLPSSDGFGSIPATGRTSTVSFSEDPTTKIRKPYTIKKSRENWTDQEHDKFLEALHLFDRDWKKIEAFVGSKTVVQIRSHAQKYFLKVQKSGANEHLPLPRPKRKASHPYPIKAPKNVAYTSLPSSSTLPLLEPGYLYSSDSKSLMGNQAVCASTSSSWNHESTNLPKPVIEEEPGVSATAPLPNNRCRQEDTERVRAVTKPNNEESCEKPHRVMPNFAEVYSFIGSVFDPNTSGHLQRLKQMDPINMETVLLLMQNLSVNLTSPEFAEQRRLISSYSAKALK

SEQ ID NO: 779 - DNA, 1084 bp, Arabidopsis thaliana
ttggcttgtacccaaacccatctttgacttcaaaaataaaataaaaataatcataattgacatcatcggataatgcatagcgggaagagacctctatcaccagaatcaatggccggaaatagagaagagaaaaaagagttgtgttgttgctcaactttgtcggaatctgatgtgtctgattttgtctctgaactcactggtcaacccatcccatcatccattgatgatcaatcttcgtcgcttactcttcaagaaaaaagtaactcgaggcaacgaaactacagaggcgtgaggcaaagaccgtggggaaaatgggcggctgagattcgtgacccgaacaaggcagctcgtgtgtggcttgggacgttcgacactgcagaagaagccgccttagcgtatgataaagctgcatttgagtttagaggtcacaaggccaagcttaacttccccgagcatattcgtgtcaaccctactcaactctatccatcgcccgctacttcccatgatcgcattatcgtgacaccacctagtccacctccaccaattgctcctgacatacttcttgatcaatatggccactttcaatctcgaagtagtgattccagtgccaacttgtccatgaatatgctgtcttcttcgtcttcatctttgaatcatcaagggctaagaccaaatttggaggatggtgaaaacgtgaagaacattagtatccacaaacgacgaaaataacatgttaatggcataaatatctcttcgtccaagttatcaaacgcattgacctccggctttgatcattttaggcgcttaatctctttacgacttcattttggtagtctttaaagagtctatggagtggatttagctaggaatcaggccttatggatgaaaaatatataaattttgaacatgactatgcaagaatgggatgaagactacttagcttggaaaacgtcctgataggtcatgacgactatatccacagaagatgaccgacggagacaacaacatgcctcacctgatcgaccgatcaaatgagataatgtgttgaccggaccggtcggatcaggttgggtcgagtatatca

SEQ ID NO: 780 - protein, 218 aa, Arabidopsis thaliana
MHSGKRPLSPESMAGNREEKKELCCCSTLSESDVSDFVSELTGQPIPSSIDDQSSSLTLQEKSNSRQRNYRGVRQRPWGKWAAEIRDPNKAARVWLGTFDTAEEAALAYDKAAFEFRGHKAKLNFPEHIRVNPTQLYPSPATSHDRIIVTPPSPPPPIAPDILLDQYGHFQSRSSDSSANLSMNMLSSSSSSLNHQGLRPNLEDGENVKNISIHKRRK

SEQ ID NO: 781 - DNA, 1104 bp, Arabidopsis thaliana
tttttagttttatttttctgtggtaaaataaaaaaagttcgccggagatgacggctgtgacggcggcgcaaagatcagttccggcgccgtttttaagcaaaacgtatcagctagttgatgatcatagcacagacgacgtcgtttcatggaacgaagaaggaacagcttttgtcgtgtggaaaacagcagagtttgctaaagatcttcttcctcaatacttcaagcataataatttctcaagcttcattcgtcagctcaacacttacggatttcgtaaaactgtaccggataaatgggaatttgcaaacgattatttccggagaggcggggaggatctgttgacggacatacgacggcgtaaatcggtgattgcttcaacggcggggaaatgtgttgttgttggttcgccttctgagtctaattctggtggtggtgatgatcacggttcaagctccacgtcatcacccggttcgtcgaagaatcctggttcggtggagaacatggttgctgatttatcaggagagaacgagaagcttaaacgtgaaaacaataacttgagctcggagctcgcggcggcgaagaagcagcgcgatgagctagtgacgttcttgacgggtcatctgaaagtaagaccggaacaaatcgataaaatgatcaaaggagggaaatttaaaccggtggagtctgacgaagagagtgagtgcgaaggttgcgacggcggcggaggagcagaggagggggtaggtgaaggattgaaattgtttggggtgtggttgaaaggagagagaaaaaagagggaccgggatgaaaagaattatgtggtgagtgggtcccgtatgacggaaataaagaacgtggactttcacgcgccgttgtggaaaagcagcaaagtctgcaactaaaaaaagagtagaagactgttcaaaccagcgtgtgacacgtcatcgacgacgacgaaaaaaatgatttaaaaaactatttttttccgtaaggaagaaaagttatttttatgttttaaaaaggtgaagaaggtccagaaggatcaacgcaaatatataaatggattttcatgtattatataatttaattagtgtattaagaaaa

SEQ ID NO: 782 - protein, 284 aa, Arabidopsis thaliana
MTAVTAAQRSVPAPFLSKTYQLVDDHSTDDVVSWNEEGTAFVVWKTAEFAKDLLPQYFKHNNFSSFIRQLNTYGFRKTVPDKWEFANDYFRRGGEDLLTDIRRRKSVIASTAGKCVVVGSPSESNSGGGDDHGSSSTSSPGSSKNPGSVENMVADLSGENEKLKRENNNLSSELAAAKKQRDELVTFLTGHLKVRPEQIDKMIKGGKFKPVESDEESECEGCDGGGGAEEGVGEGLKLFGVWLKGERKKRDRDEKNYVVSGSRMTEIKNVDFHAPLWKSSKVCN

SEQ ID NO: 783 - DNA, 1951 bp, Arabidopsis thaliana
agtaatttagttttttttttttttttttacaatttattttgttattagaagtggtagtggagtgaaaaaacaaatcctaagcagtcctaaccgatccccgaagctaaagattcttcaccttcccaaataaagcaaaacctagatccgacattgaaggaaaaaccttttagatccatctctgaaaaaaacccaaccatgaagagagatcatcatcatcatcatcaagataagaagactatgatgatgaatgaagaagacgacggtaacggcatggatgagcttctagctgttcttggttacaaggttaggtcatcggaaatggctgatgttgctcagaaactcgagcagcttgaagttatgatgtctaatgttcaagaagacgatctttctcaactcgctactgagactgttcactataatccggcggagctttacacgtggcttgattctatgctcaccgaccttaatcctccgtcgtctaacgccgagtacgatcttaaagctattcccggtgacgcgattctcaatcagttcgctatcgattcggcttcttcgtctaaccaaggcggcggaggagatacgtatactacaaacaagcggttgaaatgctcaaacggcgtcgtggaaaccaccacagcgacggctgagtcaactcggcatgttgtcctggttgactcgcaggagaacggtgtgcgtctcgttcacgcgcttttggcttgcgctgaagctgttcagaaggagaatctgactgtggcggaagctctggtgaagcaaatcggattcttagctgtttctcaaatcggagctatgagacaagtcgctacttacttcgccgaagctctcgcgcggcggatttaccgtctctctccgtcgcagagtccaatcgaccactctctctccgatactcttcagatgcacttctacgagacttgtccttatctcaagttcgctcacttcacggcgaatcaagcgattctcgaagcttttcaagggaagaaaagagttcatgtcattgatttctctatgagtcaaggtcttcaatggccggcgcttatgcaggctcttgcgcttcgacctggtggtcctcctgttttccggttaaccggaattggtccaccggcaccggataatttcgattatcttcatgaagttgggtgtaagctggctcatttagctgaggcgattcacgttgagtttgagtacagaggatttgtggctaacactttagctgatcttgatgcttcgatgcttgagcttagaccaagtgagattgaatctgttgcggttaactctgttttcgagcttcacaagctcttgggacgacctggtgcgatcgataaggttcttggtgtggtgaatcagattaaaccggagattttcactgtggttgagcaggaatcgaaccataatagtccgattttcttagatcggtttactgagtcgttgcattattactcgacgttgtttgactcgttggaaggtgtaccgagtggtcaagacaaggtcatgtcggaggtttacttgggtaaacagatctgcaacgttgtggcttgtgatggacctgaccgagttgagcgtcatgaaacgttgagtcagtggaggaaccggttcgggtctgctgggtttgcggctgcacatattggttcgaatgcgtttaagcaagcgagtatgcttttggctctgttcaacggcggtgagggttatcgggtggaggagagtgacggctgtctcatgttgggttggcacacacgaccgctcatagccacctcggcttggaaactctccaccaattagatggtggctcaatgaattgatctgttgaaccggttatgatgatagatttccgaccgaagccaaactaaatcctactgtttttccctttgtcacttgttaagatcttatctttcattatattaggtaattgaaaaattttaatctcgcctaaattact

SEQ ID NO: 784 - protein, 532 aa, Arabidopsis thaliana
MKRDHHHHHQDKKTMMMNEEDDGNGMDELLAVLGYKVRSSEMADVAQKLEQLEVMMSNVQEDDLSQLATETVHYNPAELYTWLDSMLTDLNPPSSNAEYDLKAIPGDAILNQFAIDSASSSNQGGGGDTYTTNKRLKCSNGVVETTTATAESTRHVVLVDSQENGVRLVHALLACAEAVQKENLTVAEALVKQIGFLAVSQIGAMRQVATYFAEALARRIYRLSPSQSPIDHSLSDTLQMHFYETCPYLKFAHFTANQAILEAFQGKKRVHVIDFSMSQGLQWPALMQALALRPGGPPVFRLTGIGPPAPDNFDYLHEVGCKLAHLAEAIHVEFEYRGFVANTLADLDASMLELRPSEIESVAVNSVFELHKLLGRPGAIDKVLGVVNQIKPEIFTVVEQESNHNSPIFLDRFTESLHYYSTLFDSLEGVPSGQDKVMSEVYLGKQICNVVACDGPDRVERHETLSQWRNRFGSAGFAAAHIGSNAFKQASMLLALFNGGEGYRVEESDGCLMLGWHTRPLIATSAWKLSTN

SEQ ID NO: 785 - DNA, 1440 bp, Arabidopsis thaliana
gaggaaaactcgaaaaagctacacacaagaagaagaagaaaagatacgagcaagaagactaaacacgaaagcgatttatcaactcgaaggaagagactttgattttcaaatttcgtcccctatagattgtgttgtttctgggaaggagatggcagtttatgatcagagtggagatagaaacagaacacaaattgatacatcgaggaaaaggaaatctagaagtagaggtgacggtactactgtggctgagagattaaagagatggaaagagtataacgagaccgtagaagaagtttctaccaagaagaggaaagtacctgcgaaagggtcgaagaagggttgtatgaaaggtaaaggaggaccagagaatagccgatgtagtttcagaggagttaggcaaaggatttggggtaaatgggttgctgagatcagagagcctaatcgaggtagcaggctttggcttggtactttccctactgctcaagaagctgcttctgcttatgatgaggctgctaaagctatgtatggtcctttggctcgtcttaatttccctcggtctgatgcgtctgaggttacgagtacctcaagtcagtctgaggtgtgtactgttgagactcctggttgtgttcatgtgaaaacagaggatccagattgtgaatctaaacccttctccggtggagtggagccgatgtattgtctggagaatggtgcggaagagatgaagagaggtgttaaagcggataagcattggctgagcgagtttgaacataactattggagtgatattctgaaagagaaagagaaacagaaggagcaagggattgtagaaacctgtcagcaacaacagcaggattcgctatctgttgcagactatggttggcccaatgatgtggatcagagtcacttggattcttcagacatgtttgatgtcgatgagcttctacgtgacctaaatggcgacgatgtgtttgcaggcttaaatcaggaccggtacccggggaacagtgttgccaacggttcatacaggcccgagagtcaacaaagtggttttgatccgctacaaagcctcaactacggaatacctccgtttcagctcgagggaaaggatggtaatggattcttcgacgacttgagttacttggatctggagaactaaacaaaacaatatgaagctttttggatttgatatttgccttaatcccacaacgactgttgattctctatccgagttttagtgatatagagaactacagaacacgttttttcttgttataaaggtgaactgtatatatcgaaacagtgatatgacaatagagaagacaactatagtttgttagtctgcttctcttaagttgttctttagatatgttttatgttttgtaacaacaggaatgaataatacacacttgtgaagcttttaaaaaaaaaaaaaaaaaaaaa

SEQ ID NO: 786 - protein, 335 aa, Arabidopsis thaliana
MAVYDQSGDRNRTQIDTSRKRKSRSRGDGTTVAERLKRWKEYNETVEEVSTKKRKVPAKGSKKGCMKGKGGPENSRCSFRGVRQRIWGKWVAEIREPNRGSRLWLGTFPTAQEAASAYDEAAKAMYGPLARLNFPRSDASEVTSTSSQSEVCTVETPGCVHVKTEDPDCESKPFSGGVEPMYCLENGAEEMKRGVKADKHWLSEFEHNYWSDILKEKEKQKEQGIVETCQQQQQDSLSVADYGWPNDVDQSHLDSSDMFDVDELLRDLNGDDVFAGLNQDRYPGNSVANGSYRPESQQSGFDPLQSLNYGIPPFQLEGKDGNGFFDDLSYLDLEN

SEQ ID NO: 787 - DNA, 909 bp, Arabidopsis thaliana
ctcctgtcttgtctaaagaaaaaagagagaggaagaaatggagacttttgaggaaagctctgatttggatgttatacagaaacatctatttgaagacttgatgatccctgatggtttcattgaagattttgtctttgatgatactgcttttgtctccggactctggtctctagaaccctttaacccagttccgaaactggaacctagttcacctgttcttgatccagattcctatgtccaagagattctgcaaatggaagcagaatcatcatcatcatcatcaacaacaacgtcacctgaggttgagactgtctcaaaccggaaaaaaacaaagaggtttgaagaaacgagacattacagaggcgtgagaaggaggccatgggggaaatttgcagcagagattcgagatccggcaaagaaaggatccaggatttggttaggcacttttgagagtgatattgatgctgcaagggcttacgactatgcagcttttaagctcaggggaagaaaagctgttctcaactttcctttggatgccggaaagtatgatgctccggtcaattcatgccgaaaaaggaggagaaccgatgtaccacagcctcaaggaacaacaacaagtacttcatcatcgtcatcaaactaatgggggaatagtgatgtttaattagtatatataggttaatatcttaagtatgtgaagcatcatgtatagagccaagaacctgttagactagtgtactgaaaagaactcttgcaaaatatgtactaaagagttcctgtaacaatggaacttctgcgttttctcttgtcttaaagagcttaaggttctagaaacaaagttcttgtcctttcggtttaaaaaaaaaaaaaaaaaaaaaaaaaaaaaaaaaaaaaaaaaaaaaaaaaaaa

SEQ ID NO: 788 - protein, 201 aa, Arabidopsis thaliana
METFEESSDLDVIQKHLFEDLMIPDGFIEDFVFDDTAFVSGLWSLEPFNPVPKLEPSSPVLDPDSYVQEILQMEAESSSSSSTTTSPEVETVSNRKKTKRFEETRHYRGVRRRPWGKFAAEIRDPAKKGSRIWLGTFESDIDAARAYDYAAFKLRGRKAVLNFPLDAGKYDAPVNSCRKRRRTDVPQPQGTTTSTSSSSSN

SEQ ID NO: 789 - DNA, 768 bp, Arabidopsis thaliana
atgtcgacaagggaagagaatgtttacatggcgaaattagccgaacaagctgaacgttacgaagaaatggttgaattcatggagaaagttgcgaaaactgttgatgttgaggaactttcagttgaagagaggaatcttctctctgttgcttacaagaacgtgattggagcgagaagagcttcgtggagaatcatttcttcgattgagcagaaagaagagagcaaagggaacgaagatcatgttgctattatcaaggattacagaggagagattgaatccgagcttagcaaaatctgtgatgggattttgaatgttcttgaagctcatcttattccttctgcttcaccagctgaatctaaagtgttttatcttaagatgaagggtgattatcataggtatcttgctgagtttaaggctggtgctgaaaggaaagaagctgctgaaagcactttggttgcttacaagtctgcttccgacattgccactgctgagttagctcctactcacccgataaggcttggtcttgcactcaacttctctgtgttttactatgaaatcctcaactcgcctgatcgtgcttgcagcctcgcaaagcaggcgtttgatgatgcaatcgctgagttagatacattgggtgaggaatcatacaaggacagtacactgattatgcagcttcttagagacaatctcactctctggacttcagatatgactgacgaagcaggagatgagattaaggaggcatcaaagcccgatggtgccgagtaa

SEQ ID NO: 790 - protein, 255 aa, Arabidopsis thaliana
MSTREENVYMAKLAEQAERYEEMVEFMEKVAKTVDVEELSVEERNLLSVAYKNVIGARRASWRIISSIEQKEESKGNEDHVAIIKDYRGEIESELSKICDGILNVLEAHLIPSASPAESKVFYLKMKGDYHRYLAEFKAGAERKEAAESTLVAYKSASDIATAELAPTHPIRLGLALNFSVFYYEILNSPDRACSLAKQAFDDAIAELDTLGEESYKDSTLIMQLLRDNLTLWTSDMTDEAGDEIKEASKPDGAE

SEQ ID NO: 791 - DNA, 1479 bp, Arabidopsis thaliana
aaaaagaagaatcagaaagtgaaaaagagagcgagcgatgaacagtatcttctccattgacgatttctccgatcctttctgggaaactcctccgattcctctcaatcccgactcttctaagcctgttacggcggatgaagttagccagagtcaaccggaatggactttcgagatgtttctcgaagagatttcttcgtcggcggtgagctctgagccacttggtaacaacaacaacgcgatcgtcggtgtttcttcggcgcaatctcttccttctgtttccggacagaatgatttcgaggatgatagtcgatttcgtgatcgcgattcgggaaatttggattgtgctgctcccatgacgacgaagacggtgaatgttgattccgatgattatcgtcgtgttcttaagaacaagcttgaggctgagtgcgcgactggtgtttctcttcgggttgggtctgtgaagcctgaagattcgactagttctccagaaactcaacttcaaccagttcaatccagtcctcttactcaaggagaacttggtgttacttcttccttaccagctgaggtgaaaaaaactggtgtatcaatgaagcaggttactagtggatcgtcgagagaatattctgatgacgaggaccttgatgaagagaatgaaaccaccggttccttgaagccagaggacgttaaaaaatctagaaggatgctgtcaaatcgtgagtcagctaggcgatctagaaggagaaagcaggagcaaacaagtgacctcgaaacacaggttaatgatctaaaaggtgagcattcatcacttcttaaacaactgagcaacatgaatcacaagtatgacgaggctgctgttggcaatagaatactaaaggctgacattgagacattaagagctaaggtgaaaatggcggaagaaaccgtgaagagagtaacaggaatgaatccgatgcttctcggaagatcaagtggacataacaacaacaacagaatgccaataactggtaacaacaggatggattcttctagcattattccagcttatcaaccacactcaaacctaaaccatatgtcaaaccaaaacatcgggatcccaaccattctacctccaagactcggaaacaatttcgctgctcctccatcccaaaccagctctcccttgcagagaattagaaatgggcaaaatcaccatgttactccaagcgccaacccgtatggctggaataccgaacctcagaacgattcagcatggccgaaaaaatgcgtggactgatcaaacaagaagcgggtttcgcactatattaatgtctatgcatctgtaatttgtaagtgttattaagttacgaatcatgagaaaacatcttgtgaaaatacagtctcatggcttatatatatatataagctctgtcttataacattacaagattcttatttgagaatcgtctttctatttatagctaataaaaaaaaaaaaaaaaa

SEQ ID NO: 792 - protein, 411 aa, Arabidopsis thaliana
MNSIFSIDDFSDPFWETPPIPLNPDSSKPVTADEVSQSQPEWTFEMFLEEISSSAVSSEPLGNNNNAIVGVSSAQSLPSVSGQNDFEDDSRFRDRDSGNLDCAAPMTTKTVNVDSDDYRRVLKNKLEAECATGVSLRVGSVKPEDSTSSPETQLQPVQSSPLTQGELGVTSSLPAEVKKTGVSMKQVTSGSSREYSDDEDLDEENETTGSLKPEDVKKSRRMLSNRESARRSRRRKQEQTSDLETQVNDLKGEHSSLLKQLSNMNHKYDEAAVGNRILKADIETLRAKVKMAEETVKRVTGMNPMLLGRSSGHNNNNRMPITGNNRMDSSSIIPAYQPHSNLNHMSNQNIGIPTILPPRLGNNFAAPPSQTSSPLQRIRNGQNHHVTPSANPYGWNTEPQNDSAWPKKCVD

SEQ ID NO: 793 - DNA, 2526 bp, Arabidopsis thaliana
cagttatcttcttccttcttctctctgttttttaaatttatttttagagaattttttttgttttgcttccgatttgattatttccgggaacgatgacttctccggggagttcccggtgagatgataagtcagattgcatacttgtctcctccatggctactctcaagggttttggctgcggtggattcgtttggtttctctagaatctaaagaggttatcacaacggctttgcaatttgaaaactttcatgtttggggagatcaaagatggtttcttttttatactttacttgttagagaggatttgaagcagcgaatagctgcaaccggtcctgttatggatactaatacatctggagaagaattattagctaaggcaagaaagccatatacaataacaaagcagcgagagcgatggactgaggatgagcatgagaggtttctagaagccttgaggctttatggaagagcttggcaacgaattgaagaacatattgggacaaagactgctgttcagatcagaagtcatgcacaaaagttcttcacaaagttggagaaagaggctgaagttaaaggcatccctgtttgccaagctttggacatagaaattccgcctcctcgtcctaaacgaaaacccaatactccttatcctcgaaaacctgggaacaacggtacatcttcctctcaagtatcatcagcaaaagatgcaaaacttgtttcatcggcctcttcttcacagttgaatcaggcgttcttggatttggaaaaaatgccgttctctgagaaaacatcaactggaaaagaaaatcaagatgagaattgctcgggtgtttctactgtgaacaagtatcccttaccaacgaaacaggtaagtggcgacattgaaacaagtaagacctcaactgtggacaacgcggttcaagatgttcccaagaagaacaaagacaaagatggtaacgatggtactactgtgcacagcatgcaaaactacccttggcatttccacgcagatattgtgaacgggaatatagcaaaatgccctcaaaatcatccctcaggtatggtatctcaagacttcatgtttcatcctatgagagaagaaactcacgggcacgcaaatcttcaagctacaacagcatctgctactactacagcttctcatcaagcgtttccagcttgtcattcacaggatgattaccgttcgtttctccagatatcatctactttctccaatcttattatgtcaactctcctacagaatcctgcagctcatgctgcagctacattcgctgcttcggtctggccttatgcgagtgtcgggaattctggtgattcatcaaccccaatgagctcttctcctccaagtataactgccattgccgctgctacagtagctgctgcaactgcttggtgggcttctcatggacttcttcctgtatgcgctccagctccaataacatgtgttccattctcaactgttgcagttccaactccagcaatgactgaaatggataccgttgaaaatactcaaccgtttgagaaacaaaacacagctctgcaagatcaaaccttggcttcgaaatctccagcttcatcatctgatgattcagatgagactggagtaaccaagctaaatgccgactcaaaaaccaatgatgataaaattgaggaggttgttgttactgccgctgtgcatgactcaaacactgcccagaagaaaaatcttgtggaccgctcatcgtgtggctcaaatacaccttcagggagtgacgcagaaactgatgcattagataaaatggagaaagataaagaggatgtgaaggagacagatgagaatcagccagatgttattgagttaaataaccgtaagattaaaatgagagacaacaacagcaacaacaatgcaactactgattcgtggaaggaagtctccgaagagggtcgtatagcgtttcaggctctctttgcaagagaaagattgcctcaaagcttttcgcctcctcaagtggcagagaatgtgaatagaaaacaaagtgacacgtcaatgccattggctcctaatttcaaaagccaggattcttgtgctgcagaccaagaaggagtagtaatgatcggtgttggaacatgcaagagtcttaaaacgagacagacaggatttaagccatacaagagatgttcaatggaagtgaaagagagccaagttgggaacataaacaatcaaagtgatgaaaaagtctgcaaaaggcttcgattggaaggagaagcttctacatgacagacttggaggtaaaaaaaaaacatccacatttttatcaatatctttaaatctagtgttagtagtttgcttctccaatctttatgaaagagacttttaattttccttccgaacatttctttggtcatgtcaggttctgtaccatattaccccatgtcttgtctcttgtctctgtttgtgtatgctacttgtggtctatatgtcatctgctactactgttaattaaccattaagcaatggatttgtcttta

SEQ ID NO: 794 - protein, 645 aa, Arabidopsis thaliana
MDTNTSGEELLAKARKPYTITKQRERWTEDEHERFLEALRLYGRAWQRIEEHIGTKTAVQIRSHAQKFFTKLEKEAEVKGIPVCQALDIEIPPPRPKRKPNTPYPRKPGNNGTSSSQVSSAKDAKLVSSASSSQLNQAFLDLEKMPFSEKTSTGKENQDENCSGVSTVNKYPLPTKQVSGDIETSKTSTVDNAVQDVPKKNKDKDGNDGTTVHSMQNYPWHFHADIVNGNIAKCPQNHPSGMVSQDFMFHPMREETHGHANLQATTASATTTASHQAFPACHSQDDYRSFLQISSTFSNLIMSTLLQNPAAHAAATFAASVWPYASVGNSGDSSTPMSSSPPSITAIAAATVAAATAWWASHGLLPVCAPAPITCVPFSTVAVPTPAMTEMDTVENTQPFEKQNTALQDQTLASKSPASSSDDSDETGVTKLNADSKTNDDKIEEVVVTAAVHDSNTAQKKNLVDRSSCGSNTPSGSDAETDALDKMEKDKEDVKETDENQPDVIELNNRKIKMRDNNSNNNATTDSWKEVSEEGRIAFQALFARERLPQSFSPPQVAENVNRKQSDTSMPLAPNFKSQDSCAADQEGVVMIGVGTCKSLKTRQTGFKPYKRCSMEVKESQVGNINNQSDEKVCKRLRLEGEAST

SEQ ID NO: 795 - DNA, 1281 bp, Arabidopsis thaliana
cacaacacaaacacatttctgttttctccattgtttcaaaccataaaaaaaaacacagattaaatggaatcgagtagcgttgatgagagtactacaagtacaggttccatctgtgaaaccccggcgataactccggcgaaaaagtcgtcggtaggtaacttatacaggatgggaagcggatcaagcgttgtgttagattcagagaacggcgtagaagctgaatctaggaagcttccgtcgtcaaaatacaaaggtgtggtgccacaaccaaacggaagatggggagctcagatttacgagaaacaccagcgcgtgtggctcgggacattcaacgaagaagacgaagccgctcgtgcctacgacgtcgcggttcacaggttccgtcgccgtgacgccgtcacaaatttcaaagacgtgaagatggacgaagacgaggtcgatttcttgaattctcattcgaaatctgagatcgttgatatgttgaggaaacatacttataacgaagagttagagcagagtaaacggcgtcgtaatggtaacggaaacatgactaggacgttgttaacgtcggggttgagtaatgatggtgtttctacgacggggtttagatcggcggaggcactgtttgagaaagcggtaacgccaagcgacgttgggaagctaaaccgtttggttataccgaaacatcacgcagagaaacattttccgttaccgtcaagtaacgtttccgtgaaaggagtgttgttgaactttgaggacgttaacgggaaagtgtggaggttccgttactcgtattggaacagtagtcagagttatgttttgactaaaggttggagcaggttcgttaaggagaagaatctacgtgctggtgacgtggttagtttcagtagatctaacggtcaggatcaacagttgtacattgggtggaagtcgagatccgggtcagatttagatgcgggtcgggttttgagattgttcggagttaacatttcaccggagagttcaagaaacgacgtcgtaggaaacaaaagagtgaacgatactgagatgttatcgttggtgtgtagcaagaagcaacgcatctttcacgcctcgtaacaactcttcttctttttttttcttttgttgttttaataatttttaaaaactccattttcgttttctttatttgcatcggtttctttcttcttgtttaccaaaggttcatgagttgtttttgttgtattgatgaactgtaaattttatttataggataaattttaaaaaaaaaaaaaaaaaaaa

SEQ ID NO: 796 - protein, 344 aa, Arabidopsis thaliana
MESSSVDESTTSTGSICETPAITPAKKSSVGNLYRMGSGSSVVLDSENGVEAESRKLPSSKYKGVVPQPNGRWGAQIYEKHQRVWLGTFNEEDEAARAYDVAVHRFRRRDAVTNFKDVKMDEDEVDFLNSHSKSEIVDMLRKHTYNEELEQSKRRRNGNGNMTRTLLTSGLSNDGVSTTGFRSAEALFEKAVTPSDVGKLNRLVIPKHHAEKHFPLPSSNVSVKGVLLNFEDVNGKVWRFRYSYWNSSQSYVLTKGWSRFVKEKNLRAGDVVSFSRSNGQDQQLYIGWKSRSGSDLDAGRVLRLFGVNISPESSRNDVVGNKRVNDTEMLSLVCSKKQRIFHAS

SEQ ID NO: 797 - DNA, 840 bp, Arabidopsis thaliana
atggaggagacagaaaagaataagggcagcataagtatggttgaggctaatctacctcctggttttagattccatcctagagacgacgagctcgtctgtgactacttaatgagaagaaccgttcgcagcctctatcaaccagttgtcttgatcgacgtcgatcttaacaaatgcgagccttgggacattcctcaaacggcgagagtgggagggaaagaatggtacttttacagccaaaaagaccgtaaatacgcaacaggctacagaacaaaccgggctacggccaccggttattggaaagccaccgggaaagatagagcaatccaaagaaacggtggtcttgtgggtatgagaaagacacttgtgttttaccgaggtcgatcccctaaaggtcgtaaaactgattgggtcatgcatgagtttcgtctccaaggaaaacttcttcaccactcccctaattctctcgaggaagagtgggtattgtgtagagttttccacaagaacagcaacggagctgatatagacgacatcacaaggagctgctctgatgcaacagcttctgcattcatggactcttacatcaacttcgaccatcatcacatcatcaatcagcatgtaccctgcttctccaataatttgtcacataaccaaaccaaccaatccggtttaatctccaagaactccagcccattgtttaatgcttcccctgatcaaatgattctcagaactttgctaagtcaactcacaaaaaaagtcgaagaatcacagagtcgtggagacggaagctcagagagccaattgaccgacattggcatcccaagccatgcatggaattactga

SEQ ID NO: 798 - protein, 279 aa, Arabidopsis thaliana
MEETEKNKGSISMVEANLPPGFRFHPRDDELVCDYLMRRTVRSLYQPVVLIDVDLNKCEPWDIPQTARVGGKEWYFYSQKDRKYATGYRTNRATATGYWKATGKDRAIQRNGGLVGMRKTLVFYRGRSPKGRKTDWVMHEFRLQGKLLHHSPNSLEEEWVLCRVFHKNSNGADIDDITRSCSDATASAFMDSYINFDHHHIINQHVPCFSNNLSHNQTNQSGLISKNSSPLFNASPDQMILRTLLSQLTKKVEESQSRGDGSSESQLTDIGIPSHAWNY

SEQ ID NO: 799 - DNA, 1082 bp, Arabidopsis thaliana
cgatcgatcttgaattgattctttgtagtattttatttacatatatatatagatgggaagacattcatgttgttacaaacagaaactgaggaaaggactttggtctcctgaagaagatgagaagcttcttcgttacatcactaagtatggtcatggttgctggagctctgtccctaaacaagctggtttacagagatgtggaaaaagttgtagattaagatggataaattatttaagaccagatttgaagagaggagcattttctcaagatgaagaaaatctcattattgaacttcatgccgttcttggcaatagatggtctcagatagctgcacagcttcctggaagaaccgacaatgaaatcaagaatctttggaattcttgtttgaagaagaaattgaggctgagaggaattgacccggttacacacaagctcttaaccgaaatcgaaaccggtacagatgacaaaacaaaaccggttgagaagagtcaacagacctacctcgttgagactgatggctcctctagtaccactacttgtagtactaaccaaaacaacaacactgatcatctttataccggaaatttcggttttcaacggttaagtctagaaaacggttcaagaatcgcagccggttctgacctcggtatctggattccccaaaccggaagaaaccatcatcatcatgtcgatgaaaccatccctagtgcagtggtactacccggttcaatgttctcatccggtttaaccggttatagatcctccaatctcggtttaattgaattggaaaactcattctcaaccgggccaatgatgacagagcatcagcaaattcaagagagtaactacaacaattcaacattctttggaaatgggaatctgaattggggattaacaatggaggaaaatcaaaatccattcacaatatcgaatcattcaaattcgtccttatacagtgatataaaatcagagaccaatttttttggcacagaggctacaaatgttggtatgtggccatgtaaccagcttcagcctcagcaacatgcatatggccatatataaatcttcttgtatattataa

SEQ ID NO: 800 - protein, 336 aa, Arabidopsis thaliana
MGRHSCCYKQKLRKGLWSPEEDEKLLRYITKYGHGCWSSVPKQAGLQRCGKSCRLRWINYLRPDLKRGAFSQDEENLIIELHAVLGNRWSQIAAQLPGRTDNEIKNLWNSCLKKKLRLRGIDPVTHKLLTEIETGTDDKTKPVEKSQQTYLVETDGSSSTTTCSTNQNNNTDHLYTGNFGFQRLSLENGSRIAAGSDLGIWIPQTGRNHHHHVDETIPSAVVLPGSMFSSGLTGYRSSNLGLIELENSFSTGPMMTEHQQIQESNYNNSTFFGNGNLNWGLTMEENQNPFTISNHSNSSLYSDIKSETNFFGTEATNVGMWPCNQLQPQQHAYGHI

SEQ ID NO: 801 - DNA, 1605 bp, Arabidopsis thaliana
tctcacctattgtaaaaatcaccagtttcgtatataaaaccctaattttctcaaaattcccaaatattgacttggaatcaaaaatccgaatggatgtgagcaaagtaaccacaagcgacggcggaggagattcaatggagactaagccatctcctcaacctcagcctgcggcgattctaagttcaaacgcgcctcctccgtttctgagcaagacctatgatatggttgatgatcacaatacagattcgattgtctcttggagtgctaataacaacagttttatcgtttggaaaccaccggagttcgctcgcgatcttcttcctaagaactttaagcataataatttctccagcttcgttagacagcttaatacctatggtttcaggaaggttgacccagatagatgggaatttgcgaatgaaggttttttaagaggtcagaagcacttgctacaatcaataactaggcgaaaacctgcccatggacagggacagggacatcagcgatctcagcactcgaatggacagaactcatctgttagcgcatgtgttgaagttggcaaatttggtctcgaagaagaagttgaaaggcttaaaagagataagaacgtccttatgcaagaactcgtcagattaagacagcagcaacagtccactgataaccaacttcaaacgatggttcagcgtctccagggcatggagaatcggcaacaacaattaatgtcattccttgcaaaggcagtacaaagccctcattttctatctcaattcttacagcagcagaatcagcaaaacgagagtaataggcgcatcagtgataccagtaagaagcggagattcaagcgagacggcattgtccgtaataatgattctgctactcctgatggacagatagtgaagtatcaacctccaatgcacgagcaagccaaagcaatgtttaaacagcttatgaagatggaaccttacaaaaccggcgatgatggtttccttctaggtaatggtacgtctactaccgagggaacagagatggagacttcatcaaaccaagtatcgggtataactcttaaggaaatgcctacagcttctgagatacagtcatcatcaccaattgaaacaactcctgaaaatgtttcggcagcatcagaagcaaccgagaactgtattccttcacctgatgatctaactcttcccgacttcactcatatgctaccggaaaataattcagagaagcctccagagagtttcatggaaccaaacctgggaggttctagtccattactagatccagatctgttgatcgatgattctttgtccttcgacattgacgactttccaatggattctgatatagaccctgttgattacggtttactcgaacgcttactcatgtcaagcccggttccagataatatggattcaacaccagtggacaatgaaacagagcaggaacaaaatggatgggacaaaactaagcatatggataatctgactcaacagatgggtctcctctctcctgaaaccttagatctctcaaggcaaaatccttgattttgggagtttttaaagtcttttgaggtaacacagtccctgagagcagcatattcat

SEQ ID NO: 802 - protein, 485 aa, Arabidopsis thaliana
MDVSKVTTSDGGGDSMETKPSPQPQPAAILSSNAPPPFLSKTYDMVDDHNTDSIVSWSANNNSFIVWKPPEFARDLLPKNFKHNNFSSFVRQLNTYGFRKVDPDRWEFANEGFLRGQKHLLQSITRRKPAHGQGQGHQRSQHSNGQNSSVSACVEVGKFGLEEEVERLKRDKNVLMQELVRLRQQQQSTDNQLQTMVQRLQGMENRQQQLMSFLAKAVQSPHFLSQFLQQQNQQNESNRRISDTSKKRRFKRDGIVRNNDSATPDGQIVKYQPPMHEQAKAMFKQLMKMEPYKTGDDGFLLGNGTSTTEGTEMETSSNQVSGITLKEMPTASEIQSSSPIETTPENVSAASEATENCIPSPDDLTLPDFTHMLPENNSEKPPESFMEPNLGGSSPLLDPDLLIDDSLSFDIDDFPMDSDIDPVDYGLLERLLMSSPVPDNMDSTPVDNETEQEQNGWDKTKHMDNLTQQMGLLSPETLDLSRQNP

SEQ ID NO: 803 - DNA, 2807 bp, Arabidopsis thaliana
cttcgttcttaccgagttccacgagcattagcttcagagaccttgaattggagtgcggttggatcaaaaacagttgagcgaagatgaggattatgattaagggaggtgtttggaagaacaccgaagatgagattctcaaagccgccgtgatgaagtatggtaagaaccaatgggctcggatctcgtctcttctcgttcgtaagtctgctaaacagtgtaaagctcgctggtacgagtggctcgatccatctatcaaaaagactgaatggaccagagaagaagatgagaagcttctacatcttgctaaacttctgcctactcaatggagaactattgctcctattgtgggtcgtacaccatctcaatgtcttgagaggtatgagaagctccttgatgcagcatgcactaaggatgaaaattatgatgcagcggatgatccacgaaaattacgtcctggtgagattgatccgaacccagaagcaaagcctgctcgtcctgatccggtagacatggacgaagatgagaaagaaatgctttctgaagcaagagctagattggctaacacgaggggaaagaaggctaaaagaaaagctagagaaaaacaacttgaggaagctagaaggcttgcttctctgcaaaaaagaagagaactaaaagcagctgggattgatggaaggcataggaaaagaaagagaaagggaatcgactataatgcagaaattccttttgaaaagagggcacctgcgggattttatgatactgcggatgaagatcgtcctgctgatcaagtaaaatttccaactaccattgaagaacttgaaggaaaaagaagagctgatgtagaagcacatttacgcaaacaagatgttgcaaggaataaaattgctcagagacaggatgctccagcagctatattgcaagcaaacaagctgaatgatccggaagttgttaggaagaggtcaaagctgatgttaccaccaccgcagatttcagaccacgagctagaagaaattgctaagatgggctatgccagtgaccttcttgccgagaatgaggagctaacagaaggcagtgctgctactcgtgcacttttggcaaattactcacaaacaccaaggcaaggaatgacacccatgaggacacctcaaagaactcctgctggtaaaggtgatgctattatgatggaagcagaaaacctggccagattaagagactctcagacacctttgctaggaggagaaaatcctgagttgcacccttctgacttcactggggtcactccgagaaagaaggagattcaaacgcctaatccaatgttgaccccttcaatgactcctggtggtgctggtcttactccaagaattggcttgacgccatcaagggatgggtcttctttttctatgacacccaaagggactcccttcagggatgaacttcacattaacgaagacatggacatgcagcaaagtgcaaaacttgagaggcagagacgagaggaagctagaaggagtttacgctctggtttgactgggcttcctcagccaaagaacgagtaccaaatagttgcacaacctcctcctgaggaaagtgaagagccagaagagaaaattgaggaagacatgtcagacaggatagcgagggaaaaggcggaggaagaagcaagacaacaggcattgcttaagaagagatccaaggtcttgcagagagatcttcctagacccccagctgcttcattggcagtaattaggaactcgttgctttcagctgatggagacaaaagttctgttgttcctcctactccgattgaggttgcagataaaatggtaagagaggagcttctacagttgctggagcatgataatgcaaagtatccgcttgatgacaaagctgagaagaagaaaggagccaagaaccgtaccaaccgttctgcttctcaagttcttgcaattgacgattttgatgaaaatgagctccaagaggctgacaaaatgataaaggaggaggggaagtttctgtgtgtgtcaatgggacatgagaacaagacacttgatgattttgtagaagctcacaacacatgcgtgaatgatctcatgtatttccccactcgaagcgcttacgagctctcaagtgttgctgggaacgcggacaaagttgcagcttttcaggaggagatggagaatgtgagaaaaaagatggaggaggatgagaagaaggcagaacacatgaaggccaagtacaaaacttatacaaagggtcatgagaggagggcagagaccgtgtggacccaaatagaggcgacattgaagcaggctgagattggtggaacagaagtagagtgctttaaagcattgaagaggcaagaagagatggctgcatcttttaggaaaaagaatttgcaagaggaagtgataaagcaaaaggaaacagagagtaaactgcagactcgctatgggaatatgttggcaatggttgaaaaagcagaggagataatggtcggtttccgagcacaggcattgaagaaacaagaggatgttgaagattctcacaaactgaaagaagctaagctagccactggagaggaagaggacatagccatagccatggaagcttctgcataaaaacttgagttttgtattgcttacaagttttaaggagacgtagcttgactttgtattggtaagtttttttaatatgagtcatgactttgtaaaaaggttatgatatattctctgtttgtatgctttgcaagagtcaagaaatttgaatgcttcaggatcaaaaaaaaaaaaaaaaaaaaaaaaaaaaaa

SEQ ID NO: 804 - protein, 844 aa, Arabidopsis thaliana
MRIMIKGGVWKNTEDEILKAAVMKYGKNQWARISSLLVRKSAKQCKARWYEWLDPSIKKTEWTREEDEKLLHLAKLLPTQWRTIAPIVGRTPSQCLERYEKLLDAACTKDENYDAADDPRKLRPGEIDPNPEAKPARPDPVDMDEDEKEMLSEARARLANTRGKKAKRKAREKQLEEARRLASLQKRRELKAAGIDGRHRKRKRKGIDYNAEIPFEKRAPAGFYDTADEDRPADQVKFPTTIEELEGKRRADVEAHLRKQDVARNKIAQRQDAPAAILQANKLNDPEVVRKRSKLMLPPPQISDHELEEIAKMGYASDLLAENEELTEGSAATRALLANYSQTPRQGMTPMRTPQRTPAGKGDAIMMEAENLARLRDSQTPLLGGENPELHPSDFTGVTPRKKEIQTPNPMLTPSMTPGGAGLTPRIGLTPSRDGSSFSMTPKGTPFRDELHINEDMDMQQSAKLERQRREEARRSLRSGLTGLPQPKNEYQIVAQPPPEESEEPEEKIEEDMSDRIAREKAEEEARQQALLKKRSKVLQRDLPRPPAASLAVIRNSLLSADGDKSSVVPPTPIEVADKMVREELLQLLEHDNAKYPLDDKAEKKKGAKNRTNRSASQVLAIDDFDENELQEADKMIKEEGKFLCVSMGHENKTLDDFVEAHNTCVNDLMYFPTRSAYELSSVAGNADKVAAFQEEMENVRKKMEEDEKKAEHMKAKYKTYTKGHERRAETVWTQIEATLKQAEIGGTEVECFKALKRQEEMAASFRKKNLQEEVIKQKETESKLQTRYGNMLAMVEKAEEIMVGFRAQALKKQEDVEDSHKLKEAKLATGEEEDIAIAMEASA

SEQ ID NO: 805 - DNA, 3004 bp, Arabidopsis thaliana
cggaaagagatcaaccaacgatagaggagaagaagaacttgcatacgcaaaaaaactttcccgggaaaattccagaaactgctttggaaaaatgtgcgagcccgatgataattccgctagaaacggcgtcactactcaaccttcgaggtcaagggagcttctaatggatgttgacgacttagatcttgacggttcatggccactagatcaaatcccttacttatcctcatcgaatcgcatgatttctccgatttttgtctcctcttcctctgagcagccttgctcgcctctctgggctttctccgacggtggaggaaatggttttcaccacgcaacctccggtggcgatgatgagaagatcagctctgtctccggtgttccttctttccgtctcgccgagtatcctctcttcctcccttactcttctccatcagcagctgagaacacaacagagaagcataacagtttccagtttccgtctccattgatgagcctagtcccaccagagaacacagacaactactgtgtgatcaaagagaggatgactcaggcgcttcgatacttcaaagaatcaaccgaacaacacgttttggctcaggtctgggctcctgtgagaaagaatggtcgtgatttgctgacgactttgggtcaaccttttgttcttaatcctaatggtaatgggcttaatcaatacaggatgatctctctcacatatatgttttctgtggatagtgaaagtgacgtagagctcggactcccgggtcgagttttccgtcagaaattgcctgaatggactccaaatgttcagtactattccagcaaagaattctcgcggcttgatcacgccttgcactacaacgtgcgtggtacactggccttgcctgtctttaatccctctggtcagtcctgcataggtgttgtggaacttataatgacctcagagaagattcactatgcacccgaagtggacaaagtttgcaaagcccttgaggcggtaaatctgaaaagctcggaaatacttgatcaccaaacaacacagatatgcaatgagagtcgccaaaacgcgcttgctgagattctcgaagtgctgacagttgtatgtgagacccataacttgcctctcgctcagacttgggttccatgtcagcatgggagcgttcttgccaatggtggcggtctaaagaaaaactgcaccagctttgacggtagctgcatgggtcaaatctgcatgtctacaaccgacatggcctgctatgtcgtggatgctcatgtctggggctttagagatgcctgtcttgaacaccatctccagaaaggccagggagtcgctggacgagcttttctcaatggtggctcatgtttctgcagagacatcaccaagttctgcaaaacgcagtacccactagtccattatgcgctcatgttcaagttgaccacttgttttgcaatatctctccagagctcttacacgggcgacgacagttacattcttgaattttttcttccttcgagtataacagacgaccaagagcaagatttgctgttgggttctattttggtgacaatgaaagaacattttcagagtctgagggttgcatctggggttgactttggtgaagatgacgacaaattgtctttcgagatcatccaagcattaccggacaagaaggttcattcaaaaatagaatccattcgagttcccttttctggttttaagtcaaatgcaacagagacgatgttgattcctcagcctgtggttcagtcttctgatccagtaaatgagaaaatcaacgtggccactgttaacggtgtggttaaggagaagaagaaaacagagaaaaagcgtgggaagactgagaaaacaatcagtctagatgtacttcagcagtatttcactggaagtctcaaagacgctgcaaagagcctaggagtttgcccgacgacaatgaagcgaatttgcaggcaacacggaatctcgcggtggccatcgaggaagatcaagaaagtgaatcgttcaatcacaaagctgaaacgagtcatcgaatctgttcaaggtactgatggaggcctcgacctgacttccatggccgttagttccatcccttggacacacggtcaaacatcagcacagccactaaactcacccaatggttccaaaccacctgagctaccaaacaccaataattcacctaaccattggtcaagtgatcacagtccgaacgagccaaatggttcgcctgagttaccaccaagcaatggtcacaagcgatcacgaacggtggatgagagcgctgggactccaacctctcatggctcatgtgacggtaaccaattagatgaaccgaaagtcccaaatcaagatccgctcttcacggttggtggatcacccgggctcctttttccaccttattctagagatcatgatgtatctgcagcttccttcgcaatgccgaacaggcttcttggttctatagaccatttccgaggaatgctcattgaagacgctggaagttcaaaagatctgagaaatctctgccccactgcagcatttgacgataagtttcaagacacaaactggatgaacaatgataataatagcaacaacaacttatacgctcccccaaaggaagaggccattgcaaatgttgcatgcgaaccatcaggctcagaaatgagaacggtaacaatcaaagcaagttacaaagacgacataatacggttcagaatatcctcgggttcaggtataatggaattgaaggatgaagtggctaagaggctgaaagttgatgcaggaacgttcgatatcaagtatcttgacgatgataacgaatgggttttaatagcttgtgatgctgatcttcaagaatgtctcgagatccctagatcctcccgcacgaaaatcgtaaggctcttagttcatgatgtaacgacaaatctagggagctcctgcgagagcactggagaattgtgacctgataattcattcgaactcttttgtaaatag

SEQ ID NO: 806 - protein, 959 aa, Arabidopsis thaliana
MCEPDDNSARNGVTTQPSRSRELLMDVDDLDLDGSWPLDQIPYLSSSNRMISPIFVSSSSEQPCSPLWAFSDGGGNGFHHATSGGDDEKISSVSGVPSFRLAEYPLFLPYSSPSAAENTTEKHNSFQFPSPLMSLVPPENTDNYCVIKERMTQALRYFKESTEQHVLAQVWAPVRKNGRDLLTTLGQPFVLNPNGNGLNQYRMISLTYMFSVDSESDVELGLPGRVFRQKLPEWTPNVQYYSSKEFSRLDHALHYNVRGTLALPVFNPSGQSCIGVVELIMTSEKIHYAPEVDKVCKALEAVNLKSSEILDHQTTQICNESRQNALAEILEVLTVVCETHNLPLAQTWVPCQHGSVLANGGGLKKNCTSFDGSCMGQICMSTTDMACYVVDAHVWGFRDACLEHHLQKGQGVAGRAFLNGGSCFCRDITKFCKTQYPLVHYALMFKLTTCFAISLQSSYTGDDSYILEFFLPSSITDDQEQDLLLGSILVTMKEHFQSLRVASGVDFGEDDDKLSFEIIQALPDKKVHSKIESIRVPFSGFKSNATETMLIPQPVVQSSDPVNEKINVATVNGVVKEKKKTEKKRGKTEKTISLDVLQQYFTGSLKDAAKSLGVCPTTMKRICRQHGISRWPSRKIKKVNRSITKLKRVIESVQGTDGGLDLTSMAVSSIPWTHGQTSAQPLNSPNGSKPPELPNTNNSPNHWSSDHSPNEPNGSPELPPSNGHKRSRTVDESAGTPTSHGSCDGNQLDEPKVPNQDPLFTVGGSPGLLFPPYSRDHDVSAASFAMPNRLLGSIDHFRGMLIEDAGSSKDLRNLCPTAAFDDKFQDTNWMNNDNNSNNNLYAPPKEEAIANVACEPSGSEMRTVTIKASYKDDIIRFRISSGSGIMELKDEVAKRLKVDAGTFDIKYLDDDNEWVLIACDADLQECLEIPRSSRTKIVRLLVHDVTTNLGSSCESTGEL

SEQ ID NO: 807 - DNA, 1125 bp, Arabidopsis thaliana
cgtcgacctcttgacgatcatgagactgatttcgtgaaaatatcgtcattatatcaaattagaagttgatggaaaacatgggggattcgagcatagggccgggccatccgcatctccctcccgggtttcggtttcacccgactgatgaggaactagtagttcattacctcaagaagaaagcagattctgttccacttccagtctcaatcatcgcagagattgatctttacaagtttgatccttgggagcttccaagcaaggcgagttttggagagcacgagtggtacttctttagtcctcgggatcggaagtatccaaatggggttaggccaaaccgggcagcaacttccggttattggaaagcaacgggaaccgataaaccgatatttacgtgcaatagtcacaaggttggtgtcaagaaagcgcttgttttttacggtggaaagcctcctaaagggataaaaacagattggatcatgcatgaatatcgcctcactgatggtaaccttagcactgcggctaagccgcctgacttaaccacgacaaggaaaaactcactacggctagacgattgggttctatgtaggatctataagaagaatagttcacaaagaccaacaatggagagagtattacttagagaggatctaatggaaggcatgctctcaaaatcatctgctaattcttcttctacatcagtactagacaacaacgacaacaataataacaataacgaagaacactttttcgacggtatggtcgtttcttcagacaaacgttccttgtgtggtcaataccgaatgggccacgaggcctcaggatcatcttcattcggatctttcttatcgagcaagaggtttcatcatacaggtgatctcaacaatgataactacaatgtctcttttgtttcgatgcttagtgagattcctcagagttcggggtttcatgcaaatggtgttatggatacgacgtcgtctctagctgatcatggggttttaagacaggcgtttcagcttcctaacatgaactggcactcataatctatatagatatatatgtgtgtatcatatatgtatctatgcaggcctaatatagtttacacataaatcatctggggcggccgct

SEQ ID NO: 808 - protein, 323 aa, Arabidopsis thaliana
MENMGDSSIGPGHPHLPPGFRFHPTDEELVVHYLKKKADSVPLPVSIIAEIDLYKFDPWELPSKASFGEHEWYFFSPRDRKYPNGVRPNRAATSGYWKATGTDKPIFTCNSHKVGVKKALVFYGGKPPKGIKTDWIMHEYRLTDGNLSTAAKPPDLTTTRKNSLRLDDWVLCRIYKKNSSQRPTMERVLLREDLMEGMLSKSSANSSSTSVLDNNDNNNNNNEEHFFDGMVVSSDKRSLCGQYRMGHEASGSSSFGSFLSSKRFHHTGDLNNDNYNVSFVSMLSEIPQSSGFHANGVMDTTSSLADHGVLRQAFQLPNMNWHS

SEQ ID NO: 809 - DNA, 2628 bp, Arabidopsis thaliana
tctttctttcttcaattcgccgtcaaaatcttctctttctcttcccccgccggtccttcaccaatcctctgatctctctacacacgaacctttgattttgaccaacgtcgatgcatgttcatgactagtctcttcctcaatccttcaatttcatcaattcacgtcgatttcgtatccgattcgttgttctagctctttgtgtggtgttagggttttaagattttggaattggggtttggagtttgtgatgtttgaagtcaaaatggggtcaaagatgtgcatgaacgcttcatgtggtacgacttctactgttgaatggaagaaaggttggcctcttcgatctggtcttctcgctgatctctgttatcgttgcggatctgcgtatgagagttctctattctgtgaacaatttcataaggaccaatctggttggagggaatgctatttgtgtagcaagagactacattgtggatgcattgcttctaaggtaacgattgagttaatggactatggtggtgttggttgtagtacatgtgcttgctgccatcaactcaatttgaacacaaggggtgagaatccaggtgtttttagcagattgccaatgaaaacgttagctgataggcaacatgtaaatggcgaaagcggaggaagaaacgaaggcgatctcttttctcagccactagtcatgggcggagataaaagggaagagttcatgcctcaccgtgggtttggtaagctaatgagtccagaaagtacaaccaccgggcataggctggatgctgctggggaaatgcatgaatcatcacctttacagccatctttaaatatgggtttggctgtgaatccgtttagcccatcttttgcaaccgaggctgtcgagggaatgaaacacatcagtccttctcagtccaacatggtccattgctctgcttctaatatactgcaaaagccatcaagacctgctatttcaactcctcctgtggctagtaaatccgctcaggcgcggattggaaggcctcctgtcgaagggcgagggagaggccacttgcttccgcggtattggccaaaatatacggataaagaggttcagcagatctctggaaatttgaatttgaacattgtacctctctttgagaaaactcttagtgccagtgatgctggtcgcattggtcgtctagttcttccaaaagcctgtgcagaggcatattttcctccgattagtcaatccgaaggcattcctttgaaaatccaagatgtgaggggtagggagtggacgttccagttcagatattggcccaataacaatagtagaatgtatgttttagaaggtgtcactccatgcatacagtccatgatgctacaggctggtgatacagtaactttcagtcgggttgatcctggcggaaaactaatcatgggttccaggaaggcagctaatgctggagacatgcagggttgtgggctcaccaacggaacatcaactgaggacacatcatcgtctggtgtaacagaaaacccaccctccataaatggttcctcgtgtatttcactaataccgaaagagttgaatggtatgcctgagaatttgaacagtgagactaacgggggcaggataggtgatgatcctacacgagttaaagagaagaagagaactcgaaccattggtgcaaaaaataagagacttcttttgcatagtgaagaatctatggagctgagactcacttgggaagaagctcaggacttgcttcgtccctctcctagtgtaaagcctaccatcgttgtcattgaggagcaagaaattgaagaatatgacgaacctcctgtctttggaaagaggactatagtcactacaaaaccttcaggtgaacaggaacgatgggcaacttgcgacgactgctctaaatggagaaggttacctgtagatgctcttctttcctttaaatggacatgtatagacaatgtttgggatgtgagtaggtgttcatgttctgcaccggaggagagtctgaaggaacttgagaatgttcttaaagtaggtagagagcacaagaagagaagaactggggaaagacaggcagcacaaagtcagcaagaaccgtgtggtttggacgcactggcgagtgcagcagtcttaggagacacaataggcgagccagaggtagcgaccacgaccagacatccaaggcacagggctggatgctcttgcatcgtgtgcattcagccaccaagtgggaaaggtaggcacaagcctacatgtggctgcactgtgtgtagcaccgtgaagagaaggttcaagacgcttatgatgaggaggaagaagaagcagttggagcgcgatgtaacagcagcagaagataagaagaagaaggacatggaactggctgagtctgataagagtaaggaggagaaggaagtgaacacagcgagaatagacctgaacagtgatccatacaataaagaagatgttgaagctgttgcggtggagaaagaagagagtcgaaaaagagcaataggacagtgttcgggcgtggtggctcaagacgccagtgatgttttaggagttacagagttagaaggagagggtaagaatgttcgtgaagagccgagagtttcaagctgatatggaaa

SEQ ID NO: 810 - protein, 790 aa, Arabidopsis thaliana
MFEVKMGSKMCMNASCGTTSTVEWKKGWPLRSGLLADLCYRCGSAYESSLFCEQFHKDQSGWRECYLCSKRLHCGCIASKVTIELMDYGGVGCSTCACCHQLNLNTRGENPGVFSRLPMKTLADRQHVNGESGGRNEGDLFSQPLVMGGDKREEFMPHRGFGKLMSPESTTTGHRLDAAGEMHESSPLQPSLNMGLAVNPFSPSFATEAVEGMKHISPSQSNMVHCSASNILQKPSRPAISTPPVASKSAQARIGRPPVEGRGRGHLLPRYWPKYTDKEVQQISGNLNLNIVPLFEKTLSASDAGRIGRLVLPKACAEAYFPPISQSEGIPLKIQDVRGREWTFQFRYWPNNNSRMYVLEGVTPCIQSMMLQAGDTVTFSRVDPGGKLIMGSRKAANAGDMQGCGLTNGTSTEDTSSSGVTENPPSINGSSCISLIPKELNGMPENLNSETNGGRIGDDPTRVKEKKRTRTIGAKNKRLLLHSEESMELRLTWEEAQDLLRPSPSVKPTIVVIEEQEIEEYDEPPVFGKRTIVTTKPSGEQERWATCDDCSKWRRLPVDALLSFKWTCIDNVWDVSRCSCSAPEESLKELENVLKVGREHKKRRTGERQAAQSQQEPCGLDALASAAVLGDTIGEPEVATTTRHPRHRAGCSCIVCIQPPSGKGRHKPTCGCTVCSTVKRRFKTLMMRRKKKQLERDVTAAEDKKKKDMELAESDKSKEEKEVNTARIDLNSDPYNKEDVEAVAVEKEESRKRAIGQCSGVVAQDASDVLGVTELEGEGKNVREEPRVSS

SEQ ID NO: 811 - DNA, 1389 bp, Arabidopsis thaliana
tctcaataacacaaaaccttttaaactagtaaaatacacagattttaggatgagccaatgtgttccaaactgtcacatcgatgatactccggcagcagccaccaccaccgtccgctccaccacagccgcagacatccccatattagactacgaggtagccgagctgacgtgggagaacgggcaactaggcttgcacggcttaggtccaccgcgagtgacggcttcgtcgaccaagtactccacaggcgccggtggaacgttggagtcgatagtggaccaagctactcgcctccctaaccctaagcccacggatgagctcgtcccgtggttccatcatcgctcctccagggccgcgatggcaatggacgcgcttgtcccttgctccaacctagtacacgagcagcagagcaagcctggtggcgttggctccacccgggtggggtcatgtagcgatggtcgtaccatgggcggtggaaaacgagcaagagtggcaccggagtggagcggcggcgggagtcagcggctgaccatggacacttacgacgtaggtttcacctcaacatcaatgggctcgcacgataacacaatcgacgatcatgactccgtctgccacagccgcccacagatggaggacgaagaagagaagaaagccggaggaaaatcatcagtttcaaccaagagaagcagagctgctgctattcataaccaatccgaacgtaagaggagagataaaatcaatcaaaggatgaagactttgcaaaaactggttcccaattccagcaagacggataaagcatctatgttggatgaagtgatagagtatttgaagcaacttcaagcacaagtgagcatgatgagcagaatgaatatgccttctatgatgcttcctatggccatgcagcaacaacaacaactacaaatgtctctcatgtccaatcccatgggtttagggatgggcatggggatgcccggtctcggtctcctcgaccttaattctatgaaccgagctgctgcaagcgctcctaatatccatgccaacatgatgccaaacccatttttgcccatgaattgtccatcgtgggatgcttcttccaatgactctcgatttcagtctcctctcatccccgatcctatgtctgcctttcttgcatgctctactcagccaacgacgatggaagcgtatagcaggatggctacattatatcagcaaatgcaacaacaacttcctcctccttcgaatccaaaatgattattactcaaacacctctatatagtttacgtctatatatgtgttagtcacatacatacatatatatattccatcataattatttatttatatgtataggcttctcatgaattatgatattatacgtattacgtaaaaaa

SEQ ID NO: 812 - protein, 399 aa, Arabidopsis thaliana
MSQCVPNCHIDDTPAAATTTVRSTTAADIPILDYEVAELTWENGQLGLHGLGPPRVTASSTKYSTGAGGTLESIVDQATRLPNPKPTDELVPWFHHRSSRAAMAMDALVPCSNLVHEQQSKPGGVGSTRVGSCSDGRTMGGGKRARVAPEWSGGGSQRLTMDTYDVGFTSTSMGSHDNTIDDHDSVCHSRPQMEDEEEKKAGGKSSVSTKRSRAAAIHNQSERKRRDKINQRMKTLQKLVPNSSKTDKASMLDEVIEYLKQLQAQVSMMSRMNMPSMMLPMAMQQQQQLQMSLMSNPMGLGMGMGMPGLGLLDLNSMNRAAASAPNIHANMMPNPFLPMNCPSWDASSNDSRFQSPLIPDPMSAFLACSTQPTTMEAYSRMATLYQQMQQQLPPPSNPK

SEQ ID NO: 813 - DNA, 1107 bp, Arabidopsis thaliana
ttttctttgggtgttccttccaccaacggcagaaatcgattcggcttaaatctccccctcctttcgatctctctgatcgccgccgggaacattcaatttcccgggagttcaacaaaaaaaaaactctccgtttttatttttccccctttttcaccggtggaagtttccggagatggtgtcacccgaaaacgctaattggatttgtgacttgatcgatgctgattacggaagtttcacaatccaaggtcctggtttctcttggcctgttcagcaacctattggtgtttcttctaactccagtgctggagttgatggctcggctggaaactcagaagctagcaaagaacctggatccaaaaagagggggagatgtgaatcatcctctgccactagctcgaaagcatgtagagagaagcagcgacgggacaggttgaatgacaagtttatggaattgggtgcaattttggagcctggaaatcctcccaaaacagacaaggctgctatcttggttgatgctgtccgcatggtgacacagctacggggcgaggcccagaagctgaaggactccaattcaagtcttcaggacaaaatcaaagagttaaagactgagaaaaacgagctgcgagatgagaaacagaggctgaagacagagaaagaaaagctggagcagcagctgaaagccatgaatgctcctcaaccaagttttttcccagccccacctatgatgcctactgcttttgcttcagcgcaaggccaagctcctggaaacaagatggtgccaatcatcagttacccaggagttgccatgtggcagttcatgcctcctgcttcagtcgatacttctcaggatcatgtccttcgtcctcctgttgcttaatcaagaaaaatcatcaaccggtttgcttcttgcttccgcttaaaagaaaagtctccatttgttttgctctcctctctttctcggctttcttagtcttatccttttgctttgtcgtgttatcatcgtaactgttatctgttgaacaatgatatgacattgtaaactccaattgcttcgcgcaatgttatctattcacatgtaaatttaagtagagtttggcaaaaaaaaaa

SEQ ID NO: 814 - protein, 234 aa, Arabidopsis thaliana
MVSPENANWICDLIDADYGSFTIQGPGFSWPVQQPIGVSSNSSAGVDGSAGNSEASKEPGSKKRGRCESSSATSSKACREKQRRDRLNDKFMELGAILEPGNPPKTDKAAILVDAVRMVTQLRGEAQKLKDSNSSLQDKIKELKTEKNELRDEKQRLKTEKEKLEQQLKAMNAPQPSFFPAPPMMPTAFASAQGQAPGNKMVPIISYPGVAMWQFMPPASVDTSQDHVLRPPVA

SEQ ID NO: 815 - DNA, 1134 bp, Arabidopsis thaliana
cttcttcctcctcctccatctcttctctttactctctctttaatcatctctcattcttgaatcttgatccatcaaaatcaatcccgttctcgaaagatccattaaaatcaaaacctaagctctctctcttgcttctagggtttttttgttcgttgtgatggcgagagaaaagattcagatcaggaagatcgacaacgcaacggcgagacaagtgacgttttcgaaacgaagaagagggcttttcaagaaagctgaagaactctccgttctctgcgacgccgatgtcgctctcatcatcttctcttccaccggaaaactgttcgagttctgtagctccagcatgaaggaagtcctagagaggcataacttgcagtcaaagaacttggagaagcttgatcagccatctcttgagttacagctggttgagaacagtgatcacgcccgaatgagtaaagaaattgcggacaagagccaccgactaaggcaaatgagaggagaggaacttcaaggacttgacattgaagagcttcagcagctagagaaggcccttgaaactggtttgacgcgtgtgattgaaacaaagagtgacaagattatgagtgagatcagcgaacttcagaaaaagggaatgcaattgatggatgagaacaagcggttgaggcagcaaggaacgcaactaacggaagagaacgagcgacttggcatgcaaatatgtaacaatgtgcatgcacacggtggtgctgaatcggagaacgctgctgtgtacgaggaaggacagtcgtcggagtctattactaacgccggaaactctaccggagcgcctgttgactccgagagctccgacacttcccttaggctcggcttaccgtatggtggttagagatggaacaattcaaagaagttgatggagtgaggagagtaatgtaaatctttttaactcggtagtaacaagagacaatgtctaagtagtgaattctcaaatgtttgtgtaagtttctgcctatggaagaggctttcatttttatgattttcactatgtatgatctctcttcactgcatttctggttagtaacggcttgtcaccgataaactttctcgttatggaaagttagaataaaaaaaaaaaaaaaaaaa

SEQ ID NO: 816 - protein, 240 aa, Arabidopsis thaliana
MAREKIQIRKIDNATARQVTFSKRRRGLFKKAEELSVLCDADVALIIFSSTGKLFEFCSSSMKEVLERHNLQSKNLEKLDQPSLELQLVENSDHARMSKEIADKSHRLRQMRGEELQGLDIEELQQLEKALETGLTRVIETKSDKIMSEISELQKKGMQLMDENKRLRQQGTQLTEENERLGMQICNNVHAHGGAESENAAVYEEGQSSESITNAGNSTGAPVDSESSDTSLRLGLPYGG

SEQ ID NO: 817 - DNA, 1755 bp, Arabidopsis thaliana
atgatgatgtttaacgagatgggaatgtatggaaacatggatttcttctcttcctccacatctctcgatgtgtgtccattaccacaagctgaacaagaacctgtagttgaagatgtcgactacaccgatgatgagatggatgtggatgagcttgagaagaggatgtggagagacaaaatgcgtttgaaacgtctcaaggagcaacagagtaagtgtaaagaaggcgtcgatggttcgaaacagaggcagtcgcaagagcaagctaggaggaagaaaatgtctagagcccaagatgggatcttgaagtatatgttgaagatgatggaagtttgtaaagctcaaggctttgtttatggtattattcctgagaagggtaagcctgtgactggtgcttcggataatttgagggaatggtggaaagataaggttaggtttgatcgtaatggtccagctgctattgctaagtatcagtcagagaataatatttctggagggagtaatgattgtaacagcttggttggtccaacaccgcatacgcttcaggagcttcaggacacgactcttggttcgcttttatcggctttgatgcaacattgtgatccaccgcagagacggtttcctttggagaaaggagtttctccaccttggtggcctaatgggaatgaagagtggtggcctcagcttggtttaccaaatgagcaaggtcctcctccttataagaagcctcatgatttgaagaaagcttggaaagtcggtgttttaactgcggtgatcaagcatatgtcgccggatattgcgaagatccgtaagcttgtgaggcaatcaaaatgcttgcaggataagatgacggcgaaagagagtgctacttggcttgccattattaaccaagaagaggttgtggctcgggagctttatcccgagtcatgccctcctctttcttcttcttcatcattaggaagcgggtcgcttctcattaatgattgtagcgagtatgacgttgaaggtttcgagaaggaacaacatggtttcgatgtggaagagcggaaaccagagatagtgatgatgcatcctctagcaagctttggggttgctaaaatgcaacattttcccataaaggaggaggtcgccaccacggtaaacttagagttcacgagaaagaggaagcagaacaatgatatgaatgttatggtaatggacagatcagcaggttacacttgtgagaatggtcagtgtcctcacagcaaaatgaatcttggatttcaagacaggagttcaagggacaaccaccagatggtttgtccatatagagacaatcgtttagcgtatggagcatccaagtttcatatgggtggaatgaaactagtagttcctcagcaaccagtccaaccgatcgacctatcgggcgttggagttccggaaaacgggcagaagatgatcaccgagcttatggccatgtacgacagaaatgtccaaagcaaccaaacgcctcctactttgatggaaaaccaaagcatggtcattgatgcaaaagcagctcagaatcagcagctgaatttcaacagtggcaatcaaatgtttatgcaacaagggacgaacaacggggttaacaatcggttccagatggtgtttgattcgacaccattcgatatggcagcattcgattacagagatgattggcaaaccggagcaatggaaggaatggggaagcagcagcagcagcagcagcagcagcaagatgtatcaatatggttctga

SEQ ID NO: 818 - protein, 584 aa, Arabidopsis thaliana
MMMFNEMGMYGNMDFFSSSTSLDVCPLPQAEQEPVVEDVDYTDDEMDVDELEKRMWRDKMRLKRLKEQQSKCKEGVDGSKQRQSQEQARRKKMSRAQDGILKYMLKMMEVCKAQGFVYGIIPEKGKPVTGASDNLREWWKDKVRFDRNGPAAIAKYQSENNISGGSNDCNSLVGPTPHTLQELQDTTLGSLLSALMQHCDPPQRRFPLEKGVSPPWWPNGNEEWWPQLGLPNEQGPPPYKKPHDLKKAWKVGVLTAVIKHMSPDIAKIRKLVRQSKCLQDKMTAKESATWLAIINQEEVVARELYPESCPPLSSSSSLGSGSLLINDCSEYDVEGFEKEQHGFDVEERKPEIVMMHPLASFGVAKMQHFPIKEEVATTVNLEFTRKRKQNNDMNVMVMDRSAGYTCENGQCPHSKMNLGFQDRSSRDNHQMVCPYRDNRLAYGASKFHMGGMKLVVPQQPVQPIDLSGVGVPENGQKMITELMAMYDRNVQSNQTPPTLMENQSMVIDAKAAQNQQLNFNSGNQMFMQQGTNNGVNNRFQMVFDSTPFDMAAFDYRDDWQTGAMEGMGKQQQQQQQQQDVSIWF

SEQ ID NO: 819 - DNA, 1983 bp, Arabidopsis thaliana
gattctctgtgtatgtctgaatccttacaggatccaagagctttggaaaaaagatataatgaataacaagatatgggtttagctactacaacttcttctatgtcacaagattatcatcatcaccaaggaatcttttccttctctaatggattccaccgatcatcatcaaccactcatcaggaggaagtagatgaatccgccgtcgtctccggtgctcaaattccggtttatgaaaccgccggaatgttgtctgaaatgtttgcttaccctggcggaggtggcggcggttccggtggagagattcttgatcagtctactaaacagttgctagagcaacaaaaccgtcacaacaacaacaataactcaactcttcatatgttattaccaaatcatcatcaaggttttgctttcaccgacgaaaacactatgcagccgcagcaacaacaacactttacatggccatcttcctcctccgatcatcatcaaaaccgagatatgatcggaaccgtccacgtggaaggaggaaagggtttgtctttatctctctcatcttcattagccgcagctaaagccgaggaatatagaagcatttattgtgcagccgttgatggaacttcttcttcttctaacgcatccgctcatcatcatcaattcaatcagttcaagaatcttcttcttgagaattcttcttctcaacatcatcaccatcaagttgttggacattttggttcatcatcatcatctcccatggcggcttcttcatccattggagggatctacacgttgaggaattcgaaatatacgaaaccggctcaagagttgttggaagagttttgtagtgttggaagaggacatttcaagaagaacaaacttagtaggaacaactcaaaccctaatactaccggtggaggaggaggcggagggtcctcgtcatcggccggaacagctaatgatagtcctcctttgtctccggctgatcggattgaacatcaaagaagaaaagtcaagctactatctatgcttgaagaggtggaccgacggtacaaccactactgcgaacaaatgcaaatggtagtgaactcattcgaccaagtaatgggttacggcgcggcggttccgtacacgacattagctcaaaaggcaatgtctaggcatttccggtgtttgaaagacgcggtagcggttcagcttaaacgcagctgtgagcttctaggggataaagaggcggcaggggctgcatcctcggggttaaccaaaggggaaacgccgcgattgcgtttgctagagcagagtttgcgtcagcaacgagcgtttcatcatatgggtatgatggagcaagaggcatggagaccgcaacgtggtttgcctgaacgctccgttaatatccttagagcttggctattcgagcattttcttaatccgtacccaagcgatgctgataagcacctcttagcacgacagactggtttatccagaaatcaggtgtcaaattggttcataaatgctagggttcgcctatggaaaccaatggtggaagagatgtatcaacaagaagcaaaagaaagagaagaagcagaagaagaaaatgaaaatcaacaacaacaaagaagacagcaacaaacaaacaacaacgacacgaaacccaacaacaatgaaaacaacttcactgtcataaccgcacaaactccaacgacgatgacatcgacacatcacgaaaacgactcttcattcctctcttccgtcgccgccgcttctcacggcggttcagacgcgttcaccgtcgccacgtgtcagcaagacgtcagtgacttccacgtcgacggagatggtgtgaacgtcataagattcgggaccaaacagactggtgacgtgtctcttacgcttggtctacgccactctggcaatattcctgataagaacacttctttctccgttagagactttggagatttttagtcttctttgtttctcaatttattcatc

SEQ ID NO: 820 - protein, 627 aa, Arabidopsis thaliana
MGLATTTSSMSQDYHHHQGIFSFSNGFHRSSSTTHQEEVDESAVVSGAQIPVYETAGMLSEMFAYPGGGGGGSGGEILDQSTKQLLEQQNRHNNNNNSTLHMLLPNHHQGFAFTDENTMQPQQQQHFTWPSSSSDHHQNRDMIGTVHVEGGKGLSLSLSSSLAAAKAEEYRSIYCAAVDGTSSSSNASAHHHQFNQFKNLLLENSSSQHHHHQVVGHFGSSSSSPMAASSSIGGIYTLRNSKYTKPAQELLEEFCSVGRGHFKKNKLSRNNSNPNTTGGGGGGGSSSSAGTANDSPPLSPADRIEHQRRKVKLLSMLEEVDRRYNHYCEQMQMVVNSFDQVMGYGAAVPYTTLAQKAMSRHFRCLKDAVAVQLKRSCELLGDKEAAGAASSGLTKGETPRLRLLEQSLRQQRAFHHMGMMEQEAWRPQRGLPERSVNILRAWLFEHFLNPYPSDADKHLLARQTGLSRNQVSNWFINARVRLWKPMVEEMYQQEAKEREEAEEENENQQQQRRQQQTNNNDTKPNNNENNFTVITAQTPTTMTSTHHENDSSFLSSVAAASHGGSDAFTVATCQQDVSDFHVDGDGVNVIRFGTKQTGDVSLTLGLRHSGNIPDKNTSFSVRDFGDF

SEQ ID NO: 821 - DNA, 805 bp, Arabidopsis thaliana
aaataagaatataaacacttttgtctgaaaaattatcaaagaagaagaaataaatgggtggaggaagcagatttcaagaaccagtgaggatgagccgtaggaaacaagtaacaaaagagaaggaagaagatgaaaacttcaaatctccaaatcttgaagcagagagacgtagaagagagaagcttcattgtcggcttatggctctgcgatctcatgtccccattgtcaccaacatgactaaagcaagtattgttgaagatgcgattacttacataggagagcttcaaaacaatgttaagaatctcttagagacatttcatgaaatggaagaagctcctcctgagattgatgaagaacaaacggatccaatgataaaacctgaagttgaaactagtgatcttaacgaagagatgaagaaactcggaatcgaggagaatgtgcaattgtgtaagattggggagaggaagttttggttaaagatcataacagagaagagagatgggatctttactaaattcatggaggttatgagatttctcggattcgagattatcgatattagtctaacaacttcaaatggagcaattcttattagtgcctctgttcagacacaggaactctgtgatgttgaacagacaaaagattttcttttggaagttatgagaagcaatccataagtattaattatatacatcttggaaatttcttgatctaataacatttccattggtttttattacattgttgttccattttaaatatgatatgattcagatgaaaaagagtttgtgttacaagccaatga

SEQ ID NO: 822 - protein, 207 aa, Arabidopsis thaliana
MGGGSRFQEPVRMSRRKQVTKEKEEDENFKSPNLEAERRRREKLHCRLMALRSHVPIVTNMTKASIVEDAITYIGELQNNVKNLLETFHEMEEAPPEIDEEQTDPMIKPEVETSDLNEEMKKLGIEENVQLCKIGERKFWLKIITEKRDGIFTKFMEVMRFLGFEIIDISLTTSNGAILISASVQTQELCDVEQTKDFLLEVMRSNP

SEQ ID NO: 823 - DNA, 2324 bp, Arabidopsis thaliana
tcctgtcccaaaaccaaaagacttgagagtgtgtctttagagagagatcttctctcttttatcttacgactctcacttcttatctcaaatctacttcaactctatttccagtctccacattttcccacaaatttcaactcttgttctcttcctccaaagtaaaaaacaaatcgttgcaagtgaggtttggttttggtgttatagaattatgaagagcgggaagcaatcttcgcaacctgaaaagggtacttccaggatcttgtcactgactgtcctgtttatcgcattttgcggtttctccttctacctcggtggtatattttgctctgagagagacaagattgtagccaaggatgtcacaaggacgactacaaaggctgtagcttcccctaaagaacctacagctactcctattcaaatcaaatccgtttctttcccggagtgcgggtcagagttccaagattacaccccgtgcaccgatccaaagaggtggaagaagtatggtgtccatcgcttaagtttcttggagcgtcattgtcctccggtatatgaaaagaatgagtgtttgattccaccaccagacgggtataaaccgcctataagatggcccaagagccgagaacagtgttggtacaggaacgtgccttatgattggatcaataagcaaaagtctaaccagcattggcttaagaaagaaggagataagttccatttccctggtggtggtaccatgttccctcgtggagttagtcactatgttgatttgatgcaagatctgattcctgaaatgaaagacggaacagtcaggaccgccattgatactggctgtggggttgcgagctggggaggcgatcttttggaccgtgggatactatcactctctcttgctccaagagataaccatgaagctcaggttcaatttgctcttgaacgtggaattcctgcgattctcgggatcatctctacgcaacgtctcccttttccttcaaatgcatttgatatggctcattgttcaagatgtcttattccctggacagaatttggtggaatctatttacttgagattcaccgtatagttcgacctggaggtttttgggttctttctggtccacctgtgaactataatagacgatggcgtggatggaacacaaccatggaagatcagaaatctgactacaacaagcttcagtcacttctaacctccatgtgtttcaaaaagtacgctcaaaaagatgacatagccgtgtggcagaaactctcagacaaatcttgctatgacaaaatcgctaagaacatggaagcttaccctcccaaatgtgacgacagtatagaacctgattctgcttggtacactccactccgtccttgcgtggttgccccgacacctaaagtcaagaagtctggtctcggatcaatcccaaaatggcccgagaggttacatgtcgcgcccgagagaatcggtgatgttcacggagggagtgcgaacagtttgaaacacgatgatggtaaatggaagaacagagttaagcattacaagaaagttttaccagctcttgggacagacaagataagaaatgttatggatatgaacactgtttatggaggtttctctgcggccctcattgaggatcccatttgggtcatgaacgttgtatcatcgtacagcgcaaattcgcttcctgttgtctttgatcgcggtctcatcgggacttaccacgactggtgcgaagctttctcaacgtatccaagaacatatgatcttcttcacctcgacagtctttttaccttggagagtcacaggtgtgagatgaagtacattttgctagagatggacaggatcttgcggccgagtggatatgttataatccgagaatcgagttatttcatggacgcaatcacaacgttagcgaaagggataaggtggagttgccggagagaggagactgagtatgcagtcaaaagtgagaagattctggtttgccagaaaaagctatggttttcgtcaaaccaaacctcttgatgagaccacctgtatcatagtgtttatcatctcctgtgatgcacactacagagagaaggatctagtcctttgagtccaagatatagctctataaacaatctcctttttttgttctctttaatttcttgggtatttcacggtatagattgatattatatattttttaattatatttttaatatatagatatattagtatgtggtttaaacactattattatcaaggtcttaaagatttgctttgcaagagttaaaaaatgttggagtaaggacctcttgattaataaattgactgacgcagcaaa

SEQ ID NO: 824 - protein, 603 aa, Arabidopsis thaliana
MKSGKQSSQPEKGTSRILSLTVLFIAFCGFSFYLGGIFCSERDKIVAKDVTRTTTKAVASPKEPTATPIQIKSVSFPECGSEFQDYTPCTDPKRWKKYGVHRLSFLERHCPPVYEKNECLIPPPDGYKPPIRWPKSREQCWYRNVPYDWINKQKSNQHWLKKEGDKFHFPGGGTMFPRGVSHYVDLMQDLIPEMKDGTVRTAIDTGCGVASWGGDLLDRGILSLSLAPRDNHEAQVQFALERGIPAILGIISTQRLPFPSNAFDMAHCSRCLIPWTEFGGIYLLEIHRIVRPGGFWVLSGPPVNYNRRWRGWNTTMEDQKSDYNKLQSLLTSMCFKKYAQKDDIAVWQKLSDKSCYDKIAKNMEAYPPKCDDSIEPDSAWYTPLRPCVVAPTPKVKKSGLGSIPKWPERLHVAPERIGDVHGGSANSLKHDDGKWKNRVKHYKKVLPALGTDKIRNVMDMNTVYGGFSAALIEDPIWVMNVVSSYSANSLPVVFDRGLIGTYHDWCEAFSTYPRTYDLLHLDSLFTLESHRCEMKYILLEMDRILRPSGYVIIRESSYFMDAITTLAKGIRWSCRREETEYAVKSEKILVCQKKLWFSSNQTS

SEQ ID NO: 825 - DNA, 1780 bp, Arabidopsis thaliana
tcttttcaaattccaatcatttgatcaactaatcaagaattaattataagactttgcaatctctctccctctccctctccctagctagttctctcttgtgtttcttaactcgagcttctctcaatagtgattatcatctttttcatcatttcaagatttaatgtgttttgcagaaaagagactaatcaagaagagatatcatcaattgaagctgttttcttgagtagagatggcgaaccatagaatgagcgaagctacaaaccataaccacaatcatcatcttccttattcacttattcatggtctcaacaacaatcatccatcttctggtttcattaaccaagatggatcgtccagtttcgattttggagagctagaagaagcaattgttctgcaaggtgtcaagtataggaacgaggaagccaagccacctttattaggaggaggaggaggagctacgactctggagatgttcccttcgtggccaatcagaactcaccaaactcttcctactgagagttccaagtcaggaggagagagcagcgattcaggatcggctaatttctccggcaaagctgaaagtcaacaaccggagtctcctatgagtagcaaacatcatctcatgcttcaacctcatcataataacatggcaaactcaagttcaacatctggacttccttccacttctcgaactttagctcctcctaaaccttcggaagataagaggaaggctacaacttcaggcaaacagcttgatgctaagacgttgagacgtttggcccaaaatagagaagctgctcgcaaaagccgtcttaggaaaaaggcgtatgtgcaacagctagaatcaagtaggataaagctttcccaattggagcaagaacttcagcgagctcgttctcaggggctgttcatgggtggttgtggaccaccaggacctaacatcacttccggagctgcaatatttgacatggaatatgggagatggctagaggatgataaccggcatatgtcggagattcgaaccggtcttcaggctcatttatctgacaatgatttaaggttgatcgttgacggttacattgctcattttgatgagatattccgattaaaagccgtggcagcgaaagccgatgtttttcacctcatcattgggacatggatgtccccagccgaacgttgttttatttggatggctggtttccgtccatccgacctaatcaagatattggtgtcgcaaatggatctattgacggagcaacaactgatgggaatatatagcctacaacactcgtcgcaacaagcagaggaggctctctcgcaaggcctcgaacaacttcagcaatctctcatcgatactctcgccgcatctccagtcattgacggaatgcaacaaatggctgtcgctctcggaaagatctctaatctcgaaggctttatccgccaggctgataacttgaggcagcagaccgttcaccagctgaggcggatcttgaccgtccgacaagctgcacggtgtttcctagtcatcggagagtactatggacggctcagagctcttagctccctttggttgtcacgcccacgagagacactgatgagtgatgaaacctcttgtcaaacgacgacggatttgcagattgttcagtcatctcggaaccacttctccaatttctgaatggaatgaaactttgtataactaaaaggccaagtttcattgtctgtcgtaatttcacctatttcctttaaagttgtactagagaaaagataggatcttccttcg

SEQ ID NO: 826 - protein, 481 aa, Arabidopsis thaliana
MANHRMSEATNHNHNHHLPYSLIHGLNNNHPSSGFINQDGSSSFDFGELEEAIVLQGVKYRNEEAKPPLLGGGGGATTLEMFPSWPIRTHQTLPTESSKSGGESSDSGSANFSGKAESQQPESPMSSKHHLMLQPHHNNMANSSSTSGLPSTSRTLAPPKPSEDKRKATTSGKQLDAKTLRRLAQNREAARKSRLRKKAYVQQLESSRIKLSQLEQELQRARSQGLFMGGCGPPGPNITSGAAIFDMEYGRWLEDDNRHMSEIRTGLQAHLSDNDLRLIVDGYIAHFDEIFRLKAVAAKADVFHLIIGTWMSPAERCFIWMAGFRPSDLIKILVSQMDLLTEQQLMGIYSLQHSSQQAEEALSQGLEQLQQSLIDTLAASPVIDGMQQMAVALGKISNLEGFIRQADNLRQQTVHQLRRILTVRQAARCFLVIGEYYGRLRALSSLWLSRPRETLMSDETSCQTTTDLQIVQSSRNHFSNF

SEQ ID NO: 827 - DNA, 1362 bp, Arabidopsis thaliana
ctgcatttattaagaacagtttagaaagtgtcaacccctaaaggaatgtttttagtttagaggaaagagagagaagaagaagcagcagcagaagttgttaatttgaagactatttgaggaaagacacctatatctaaatactcaaagttacaaaaatattacttcagaaaacagttccattagagagactcataaagcttctcatctaattatgagtggattgatgagttttggtgaattagaagaccaatttggtcagatttcagacactactatggaagagaagataccatttctgcaaatgcttcaatgcatagaacacccttttacaacaacagaaccaaatcagtttctccaatcacttctccagatccaaaccctagaatcaaagagctgtctcacccttgaaacaaacatcaaaagagatccgggtcaaacagatgacccggaaaaggatccaagaacagaaaacggagcagtaacggtcaaagaaaaaagaaaacggaaacgtacaagagctccaaagaacaaagacgaagttgaaaaccaaaggatgactcacattgccgtcgaacgtaatcgaagacgacaaatgaacgaacacttaaactctctccgatctctcatgcctccttcgtttcttcaacggggtgaccaagcttcgattgtaggaggggcaatagatttcatcaaggaactagagcaactcttgcaatctctagaagctgagaaacgaaaggatggaactgatgaaactcctaaaacggcgtcgtgttcttcatcttcgtctcttgcatgcactaactcttctatttctagcgtgtctacgacgtcggaaaatggatttacggcgagattcggcggtggagatacgacagaagtggaggctacggtgatacagaaccatgtgagcttaaaagttcggtgtaagagaggaaaacgacagatcttaaaagctattgtctcgattgaagaactaaagcttgcgattctacatctcactatctcttcttcctttgactttgtcatctactctttcaatctcaagatggaagatggttgtaaattaggatcagcagatgagatagcgacagccgttcatcagatcttcgagcaaatcaacggtgaagtcatgtggtcaaatcttagtcgaacttagttgacttttgactcctagtaacgtgtgtaaactttaggttacaaagaaaagggacgtgatataaataagaaaaaccaaagaggtgaaattttgggagttttaattattatcttatactttttggattttagattagtagcaaactcgcagtgttctacgatgacattattattggtcacatgaaggtttaggttaaaaaaaaa

SEQ ID NO: 828 - protein, 315 aa, Arabidopsis thaliana
MSGLMSFGELEDQFGQISDTTMEEKIPFLQMLQCIEHPFTTTEPNQFLQSLLQIQTLESKSCLTLETNIKRDPGQTDDPEKDPRTENGAVTVKEKRKRKRTRAPKNKDEVENQRMTHIAVERNRRRQMNEHLNSLRSLMPPSFLQRGDQASIVGGAIDFIKELEQLLQSLEAEKRKDGTDETPKTASCSSSSSLACTNSSISSVSTTSENGFTARFGGGDTTEVEATVIQNHVSLKVRCKRGKRQILKAIVSIEELKLAILHLTISSSFDFVIYSFNLKMEDGCKLGSADEIATAVHQIFEQINGEVMWSNLSRT

SEQ ID NO: 829 - DNA, 2816 bp, Arabidopsis thaliana
tttgtacttccggagctaaagagttatagctactgtagtagctggaagtgaagaagattttttaatagattgtacggaaaaattagggttttcaaagtttggtttcttgaagttgaattagacatgaagctgtcaacatctggattgggtcaacagggtcatgaaggagagaagtgtctgaattctgagctatggcatgcttgtgctggaccattagtctctcttccatcatctggtagtcgagttgtttactttccacagggtcacagtgaacaggtagctgctacaactaataaggaagttgatggtcacatacccaattacccaagcctaccaccacaattgatatgccagctccataatgttacaatgcatgcagatgttgagacggatgaagtctatgctcaaatgacacttcaaccattgacaccggaggagcagaaggaaacatttgtaccgattgagttggggataccgagtaagcaacctagtaattatttttgtaagactctcacagctagtgataccagtacacatggagggttttctgttcctagacgtgctgctgagaaagtgtttcctccattggattacacactgcagccaccagctcaagaactgattgcaagggatctccatgatgttgaatggaagtttaggcatatctttcggggacagcccaaacggcatctcctaactactggatggagtgtctttgtcagtgccaagcgactagtagctggagattctgtcattttcatcaggaatgaaaagaatcaactctttttgggaattcgtcatgccactcggccgcagactattgtaccatcatctgttttatctagtgatagcatgcatattggactccttgctgctgctgcacatgcttctgcaactaatagctgtttcactgttttctttcatccaagggctagccaatctgagtttgtgatacaactttccaagtacattaaagccgtttttcacacgcgtatttcagttgggatgcgctttcgcatgctcttcgagacagaagagtcgagtgtccgcaggtacatgggtactataactggtattagtgatctagattctgttcgttggccaaactctcattggcgatctgtgaaggttggttgggatgaatcgactgcaggggagagacagccaagggtttctttatgggagattgagcctctgactacctttcctatgtatccatctctttttcctctcagactaaaacgtccatggcatgctggcacatcatctttgcctgatggaaggggtgatttgggaagtggtctaacatggctaagagggggaggtggagagcagcaaggtttgcttcctctaaattatccatctgttggtttgtttccatggatgcaacaaaggctggatctcagtcaaatggggactgataataatcagcaataccaagcaatgttagctgctgggttgcagaacatcggcggtggagatcctttaagacagcagtttgtacagctgcaagagcctcaccaccaatatcttcaacaatcagcttcccataattctgatttgatgcttcagcagcaacagcagcaacaagcgtcacgccatctcatgcatgctcaaacacagattatgagtgagaatcttccgcagcagaatatgcgacaagaagttagtaaccaaccagctggacagcagcaacagctacagcaaccggaccaaaatgcatatcttaatgctttcaaaatgcaaaatggccatcttcaacagtggcagcagcaatcagagatgccatctccctcgttcatgaagtcagattttactgactcaagcaacaaatttgcaacaactgctagtccggcttctggagatggcaatcttttgaatttttctataaccggtcagtctgtactccctgagcagttaacaacagagggctggtctccaaaagcatccaacactttttctgaaccgttgtcacttccacaagcctatcctgggaagagtcttgctctagaacccggaaatccgcagaatccctctcttttcggtgttgatcccgactctggactcttcctccccagtacggttccccgctttgcttcttcatcaggagatgctgaagcttcccctatgtcactaacagattcaggatttcagaattccttatatagctgcatgcaagacacaactcatgagttattgcatggagctggacagattaactcgtccaaccaaaccaagaactttgtaaaggtttataaatctggttcggttgggcgttcattagacatctcccgattcagcagctaccacgagctgcgagaagagttagggaagatgtttgctatcgaagggttgttggaagacccccttagatcaggctggcagcttgtattcgttgacaaggaaaatgatattcttctccttggtgatgacccatgggagtcatttgtgaataacgtttggtacataaagatactatcaccagaagatgtgcatcaaatgggagatcatggagaaggcagtggtgggttattcccgcaaaacccgacccatctctagaagctgcttcggtgttagtctcatcatgctacaacgcgggagccctttgtttcccatttgaagtcgtttccactcatctttatatgccattcgttcgcatctctctcgttttgacgtttttagaaagaaacataatcatatttgtgagtatgggtcctgaaactttaggacgtactttagcttgtattagacagacactctcgtcataaacataagaacctttatgtagctgtctcagggtaactaaacttttctag

SEQ ID NO: 830 - protein, 811 aa, Arabidopsis thaliana
MKLSTSGLGQQGHEGEKCLNSELWHACAGPLVSLPSSGSRVVYFPQGHSEQVAATTNKEVDGHIPNYPSLPPQLICQLHNVTMHADVETDEVYAQMTLQPLTPEEQKETFVPIELGIPSKQPSNYFCKTLTASDTSTHGGFSVPRRAAEKVFPPLDYTLQPPAQELIARDLHDVEWKFRHIFRGQPKRHLLTTGWSVFVSAKRLVAGDSVIFIRNEKNQLFLGIRHATRPQTIVPSSVLSSDSMHIGLLAAAAHASATNSCFTVFFHPRASQSEFVIQLSKYIKAVFHTRISVGMRFRMLFETEESSVRRYMGTITGISDLDSVRWPNSHWRSVKVGWDESTAGERQPRVSLWEIEPLTTFPMYPSLFPLRLKRPWHAGTSSLPDGRGDLGSGLTWLRGGGGEQQGLLPLNYPSVGLFPWMQQRLDLSQMGTDNNQQYQAMLAAGLQNIGGGDPLRQQFVQLQEPHHQYLQQSASHNSDLMLQQQQQQQASRHLMHAQTQIMSENLPQQNMRQEVSNQPAGQQQQLQQPDQNAYLNAFKMQNGHLQQWQQQSEMPSPSFMKSDFTDSSNKFATTASPASGDGNLLNFSITGQSVLPEQLTTEGWSPKASNTFSEPLSLPQAYPGKSLALEPGNPQNPSLFGVDPDSGLFLPSTVPRFASSSGDAEASPMSLTDSGFQNSLYSCMQDTTHELLHGAGQINSSNQTKNFVKVYKSGSVGRSLDISRFSSYHELREELGKMFAIEGLLEDPLRSGWQLVFVDKENDILLLGDDPWESFVNNVWYIKILSPEDVHQMGDHGEGSGGLFPQNPTHL

SEQ ID NO: 831 - DNA, 354 bp, Arabidopsis thaliana
atgtgtagagggtttgagaaagaagaagagagaagaagcgacaatggaggatgccaaagactatgcacggagagtcacaaagctccggtaagctgtgagctttgcggcgagaacgccaccgtgtattgtgaggcagacgcagctttcctttgtaggaaatgcgatcgatgggtccattctgctaattttctagctcggagacatctccggcgcgtgatctgcacgacctgtcggaagctaactcgtcgatgtcttgtcggtgataattttaatgttgttttaccggagataaggatgatagcaaggattgaagaacatagtagtgatcacaaaattccctttgtgtttctctga

SEQ ID NO: 832 - protein, 117 aa, Arabidopsis thaliana
MCRGFEKEEERRSDNGGCQRLCTESHKAPVSCELCGENATVYCEADAAFLCRKCDRWVHSANFLARRHLRRVICTTCRKLTRRCLVGDNFNVVLPEIRMIARIEEHSSDHKIPFVFL

SEQ ID NO: 833 - DNA, 1306 bp, Arabidopsis thaliana
aaacccaccaaataactcagagcttttttgcattttttcccattctctattttgttttgtacttttggtctcactttaaaagatcataagttgaaagatttctgcagagaacaatatgttggaaggtcttgtctctcaagaaagcttgtccttaaactctatggacatgtctgtacttgaaaggcttaaatgggtacaacagcaacaacagcaactgcaacaagttgtgtcccatagcagtaataattcacctgaacttcttcagatacttcagttccatggaagcaacaatgatgagttgttggagagtagtttcagccaatttcaaatgcttggatctggttttggaccaaactataacatgggttttggtcctccacatgaatccatttcaagaacaagtagctgccatatggaacctgtggatacaatggaggttttgttgaagaccggtgaagaaaccagagccgttgccttgaagaacaagagaaaaccagaggttaagacaagggaagagcaaaagacagagaagaagatcaaagtagaggctgagacagagtcaagcatgaaaggaaaatcaaacatgggaaacactgaagcatcttcagacacttcaaaggagacatcgaaaggagcttcagagaatcagaaattagattatatccacgtgagagctcgtcgaggccaagccactgacagacacagcttagcagaaagggcgagaagagaaaagatcagcaagaaaatgaaatatctgcaagatattgtgcctggatgcaataaggtcacaggaaaagctggtatgcttgatgagatcatcaattatgttcaatgtctccaaagacaagtcgagttcctgtcgatgaaacttgctgtcttgaacccggaactagagcttgccgtggaagatgtatccgtaaaacaggcttactttacaaatgtagttgcttcaaagcaatcaataatggttgatgtgccattgtttccgttagaccagcaaggatctctagatttgtctgcgataaacccgaaccaaacgacatctatcgaagctccatctggaagctgggaaactcaatcacagagtctctacaacacatctagcctcggttttcattactaagcaagattcattgaaacaacatggttgacatcaatcaatcatcaaaatcagaagcaaattctattacatttgctcatcaaagtagtaatttcgaaatttggttaatgcattatcctttgatccttgttttctgatatttaaaccagaagaactggagatagcaatccaatgatcttgtcacca

SEQ ID NO: 834 - protein, 335 aa, Arabidopsis thaliana
MLEGLVSQESLSLNSMDMSVLERLKWVQQQQQQLQQVVSHSSNNSPELLQILQFHGSNNDELLESSFSQFQMLGSGFGPNYNMGFGPPHESISRTSSCHMEPVDTMEVLLKTGEETRAVALKNKRKPEVKTREEQKTEKKIKVEAETESSMKGKSNMGNTEASSDTSKETSKGASENQKLDYIHVRARRGQATDRHSLAERARREKISKKMKYLQDIVPGCNKVTGKAGMLDEIINYVQCLQRQVEFLSMKLAVLNPELELAVEDVSVKQAYFTNVVASKQSIMVDVPLFPLDQQGSLDLSAINPNQTTSIEAPSGSWETQSQSLYNTSSLGFHY

SEQ ID NO: 835 - DNA, 3090 bp, Arabidopsis thaliana
atgggaacgaaagtctcagacgatcttgtttccaccgtcagatcagtcgtgggttccgattactcagatatggatataatcagggctttacacatggcgaatcatgatccaacggctgctatcaatataatcttcgacactccaagtttcgccaaacctgatgtagccactcctaccccgagcggctctaatggagggaagcgagttgatagtggattaaagggctgtacttttggtgacagcggaagtgttggagcgaatcatcgcgtggaggaagaaaatgagagtgttaatggtggaggagaagagagtgtttcagggaatgagtggtggtttgttggttgttctgaattggctgggttatcgacatgtaaaggaaggaaattgaagtctggtgatgaattggtgttcacgtttccgcatagtaaaggattaaagcctgagactacgcctgggaagcgcggttttgggcggggaaggccagctttgcgtggtgcttctgatatcgttaggttctctacaaaggattcaggagagattggtagaataccaaacgagtgggctcggtgtcttctaccacttgtgagagacaagaaaattaggatagaaggcagttgcaagtcggcgcctgaagctttgagcatcatggatacaattcttctgtctgtaagcgtgtacattaatagttccatgtttcaaaagcatagtgcgacttcatttaagacagctagtaatacggcagaggaatcaatgttccatcctctcccaaatctctttcggttactcggtttgatcccctttaagaaggcagagtttactccagaggatttttactctaagaagcgacctttgagttccaaggatggttctgctattcctacttcgttgcttcaattaaacaaggtcaagaatatgaatcaagatgcaaacggagatgaaaatgagcagtgtatcagcgatggtgatcttgataacattgttggtgttggggacagttctggattaaaggaaatggaaactccacatacacttctgtgtgagcttcgtccataccaaaagcaggcacttcattggatgacccaactggagaaaggaaattgcactgatgaggcagcaacaatgcttcacccgtgttgggaagcatactgtttagcagacaagagggaactggttgtctacctgaattcttttactggtgatgctacaatacacttccctagcacacttcaaatggcaagaggaggaatattagcagacgcaatgggtcttggaaagactgtaatgaccatatcccttttgcttgcccattcttggaaagctgcatcaactgggtttctatgccccaactatgaaggagacaaagtgatcagcagttctgtagatgatctcactagtcccccggtgaaggcaaccaaatttctaggctttgataagaggcttcttgaacaaaaaagtgtacttcaaaatggtggtaacctgattgtatgtccgatgacacttttaggacagtggaagacagagattgaaatgcatgcaaagcctgggtctctatctgtctatgttcactatgggcaaagcaggccgaaggatgcaaaacttctttcccagagtgatgtggtaatcaccacatatggagttctaacatccgaattctcgcaagagaactcagcagaccatgaaggaatttatgcagttcgatggtttaggattgttcttgacgaggcacataccatcaaaaactcaaaaagccaaatttccttggctgctgcagctctggttgctgataggcgttggtgtcttacgggtactcctattcagaacaatctggaggatttatacagccttctacggtttttgaggattgaaccatggggaacttgggcatggtggaataaacttgtccaaaagccatttgaagagggtgatgagagagggttaaagctagtgcagtctatcttaaaacctatcatgcttaggagaacaaagtctagcacagaccgagaaggaaggccgattcttgttctaccccctgctgatgcacgggtcatttactgtgaactttcggagtctgagagggatttctacgacgcgctatttaaaagatccaaggtcaaatttgatcaatttgttgaacaaggcaaagttcttcataactatgcttcgatcctggaactgcttttgcgtcttcgacaatgttgtgatcacccatttttagtaatgagtcgaggggatacagcggaatactctgatctgaataagctttctaaacgtttccttagtggaaagtcttctggcttagaaagggaaggaaaagatgtaccgtcagaggcttttgttcaggaggtggtagaggaactgcgcaaaggagagcaaggagagtgtccaatatgccttgaagcacttgaggatgctgtattaacgccatgtgctcatagattatgtcgtgagtgtctcttggcaagttggagaaattctacttctgggttatgtcctgtgtgtaggaacactgtaagcaaacaagaactcatcacagcaccaaccgaaagtagattccaggttgacgtggaaaagaattgggtggaatcatcgaaaatcactgctcttctggaagagcttgaaggtcttcgttcttcaggctctaagagcattctctttagccagtggaccgctttcctcgatctcctccaaattcccctctctcggaataacttttcatttgtccgtcttgatggcacgctaagtcagcagcaacgagagaaggtccttaaagaattttccgaagatggcagtatcctggtactgttgatgtctctaaaagctggtggcgttgggataaatctaacagctgcgtccaatgcttttgtcatggatccatggtggaacccagcggtagaggaacaagctgttatgcgtattcatcgtatagggcaaactaaggaagtcaaaatcagaagattcatcgttaagggaacggttgaagagagaatggaggcggttcaggcgaggaagcagagaatgatctctggggctttaaccgatcaagaagtacgaagtgcacgtatagaggaactcaagatgttatttacctga

SEQ ID NO: 836 - protein, 1029 aa, Arabidopsis thaliana
MGTKVSDDLVSTVRSVVGSDYSDMDIIRALHMANHDPTAAINIIFDTPSFAKPDVATPTPSGSNGGKRVDSGLKGCTFGDSGSVGANHRVEEENESVNGGGEESVSGNEWWFVGCSELAGLSTCKGRKLKSGDELVFTFPHSKGLKPETTPGKRGFGRGRPALRGASDIVRFSTKDSGEIGRIPNEWARCLLPLVRDKKIRIEGSCKSAPEALSIMDTILLSVSVYINSSMFQKHSATSFKTASNTAEESMFHPLPNLFRLLGLIPFKKAEFTPEDFYSKKRPLSSKDGSAIPTSLLQLNKVKNMNQDANGDENEQCISDGDLDNIVGVGDSSGLKEMETPHTLLCELRPYQKQALHWMTQLEKGNCTDEAATMLHPCWEAYCLADKRELVVYLNSFTGDATIHFPSTLQMARGGILADAMGLGKTVMTISLLLAHSWKAASTGFLCPNYEGDKVISSSVDDLTSPPVKATKFLGFDKRLLEQKSVLQNGGNLIVCPMTLLGQWKTEIEMHAKPGSLSVYVHYGQSRPKDAKLLSQSDVVITTYGVLTSEFSQENSADHEGIYAVRWFRIVLDEAHTIKNSKSQISLAAAALVADRRWCLTGTPIQNNLEDLYSLLRFLRIEPWGTWAWWNKLVQKPFEEGDERGLKLVQSILKPIMLRRTKSSTDREGRPILVLPPADARVIYCELSESERDFYDALFKRSKVKFDQFVEQGKVLHNYASILELLLRLRQCCDHPFLVMSRGDTAEYSDLNKLSKRFLSGKSSGLEREGKDVPSEAFVQEVVEELRKGEQGECPICLEALEDAVLTPCAHRLCRECLLASWRNSTSGLCPVCRNTVSKQELITAPTESRFQVDVEKNWVESSKITALLEELEGLRSSGSKSILFSQWTAFLDLLQIPLSRNNFSFVRLDGTLSQQQREKVLKEFSEDGSILVLLMSLKAGGVGINLTAASNAFVMDPWWNPAVEEQAVMRIHRIGQTKEVKIRRFIVKGTVEERMEAVQARKQRMISGALTDQEVRSARIEELKMLFT

SEQ ID NO: 837 - DNA, 828 bp, Arabidopsis thaliana; identical to SEQ ID NO: 9

SEQ ID NO: 838 - protein, 275 aa, Arabidopsis thaliana; identical to SEQ ID NO: 10

SEQ ID NO: 839 - DNA, 826 bp, Arabidopsis thaliana
agacatacaacaccaaaatcttcttcttcaccaacatattcactttcacagcaaaaaaaaacgagaggttctctcttattcgtaccgttttagcaaacaaatgggtcggagaaagatcaagatggagatggttcaggacatgaacacacgacaggttaccttttcaaaacggaggactggtttgttcaagaaggcgagcgagttagccacgctctgcaacgctgagttgggcatcgttgtcttttcaccaggaggcaagcctttctcctacgggaaaccgaatcttgattctgttgcagagcgattcatgagagaatatgatgattcagacagtggcgatgaagaaaaaagtggtaattacaggcctaaactgaagaggctgagtgaacgtctcgatttgctcaaccaagaggttgaagctgagaaggaacgaggcgagaagagtcaggagaagcttgaatctgctggggatgagagattcaaggagtccattgagacgcttaccctcgatgaactcaatgaatacaaagataggcttcagacagtccatggtaggattgaaggtcaagtcaatcacttgcaggcttcgtcttgcctcatgcttctctccagaaaatagctagaccgacttgttagagttacattctattttttgtatcagcctacagaacttaccaacacatgaaagttattgctggtgtagaattttctgtcatctatggggtgtgactttctatttgacatcaaatgaaaatgtacctggaaatttgtctgtattaatctcaagtgtacttgctaaacttgatcagctttttcgcaaaaaaaa

SEQ ID NO: 840 - protein, 172 aa, Arabidopsis thaliana
MGRRKIKMEMVQDMNTRQVTFSKRRTGLFKKASELATLCNAELGIVVFSPGGKPFSYGKPNLDSVAERFMREYDDSDSGDEEKSGNYRPKLKRLSERLDLLNQEVEAEKERGEKSQEKLESAGDERFKESIETLTLDELNEYKDRLQTVHGRIEGQVNHLQASSCLMLLSRK

SEQ ID NO: 841 - DNA, 1300 bp, Arabidopsis thaliana
ttcgccagatccttcctctatataaggaagttcatttcatttggagaggtttcgctgacaagctgctctagcttatctggtaccgtcgacctctcactcaagggtccaaaagtgttttctctttttcagtttctctttctctttttgacagaagagaccgagaagcaatgggaagggctccgtgttgtgagaaaatcgggttgaagagagggagatggacagccgaggaagatgagatcctcaccaagtatattcagaccaatggtgaaggttcttggcgatctttgcctaagaaagctggattgttgagatgtggaaagagctgtagactaaggtggataaactacttaagaagagacttaaaaagaggaaatattacttccgacgaagaagaaataatcgtcaagttgcattcccttctcggcaacagatggtcacttattgcaacacatctaccaggaagaacagacaacgaaattaaaaactattggaactcacatctcagccgcaaaatctatgccttcactgccgtttccggagatggacacaatctactcgtcaacgatgtagtcttgaagaaatcttgttcatcgtcttctggagccaagaacaataacaagaccaagaagaagaagaagggaaggactagtaggtcatccatgaagaaacacaagcaaatggtgacggcctcacaatgtttctcacaacctaaggagctagagagtgatttcagtgagggagggcaaaatggtaattttgaaggagagtctttggggccttatgagtggttggatggtgagttagaacggctcttgagtagttgtgtctgggaatgcactagtgaagaggctgtgattggagtaaatgatgaaaaggtgtgtgagagtggggacaatagtagttgttgtgttaatttgtttgaagaagaacaaggaagcgagacaaagattggtcacgtaggaatcacagaggttgatcatgatatgacggtggaaagagaaagagagggaagttttttaagttcgaattcaaatgaaaataatgataaagattggtgggttggtctatgtaattcttcagaagttgggtttggggttgatgaggagttgcttgattgggagtttcaaggtaatgtcacttgtcaaagtgatgatctatgggatctctcagatattggagagataacattggagtgattgtaccgagcaagtggattggcggccgctctagacaggcctcgtaccggatctctagctagagctttcgttcgtatcatcggtttcgacaacgttcgtcaagt

SEQ ID NO: 842 - protein, 342 aa, Arabidopsis thaliana
MGRAPCCEKIGLKRGRWTAEEDEILTKYIQTNGEGSWRSLPKKAGLLRCGKSCRLRWINYLRRDLKRGNITSDEEEIIVKLHSLLGNRWSLIATHLPGRTDNEIKNYWNSHLSRKIYAFTAVSGDGHNLLVNDVVLKKSCSSSSGAKNNNKTKKKKKGRTSRSSMKKHKQMVTASQCFSQPKELESDFSEGGQNGNFEGESLGPYEWLDGELERLLSSCVWECTSEEAVIGVNDEKVCESGDNSSCCVNLFEEEQGSETKIGHVGITEVDHDMTVEREREGSFLSSNSNENNDKDWWVGLCNSSEVGFGVDEELLDWEFQGNVTCQSDDLWDLSDIGEITLE

SEQ ID NO: 843 - DNA, 348 bp, Arabidopsis thaliana
atgaaattgattgattggaaagactgtgctttgatgacttacaccgaactcattttgggtttctgcaatgttttaatgttgatctgcaggaggactagtggacctatgagacgagcaaaaggtggttggactccagaggaggatgagacacttagacgagcagttgaaaagtataaggggaagaggtggaagaaaatagcggaatttttcccagagagaacacaagtccaatgcttgcacaggtggcagaaagttcttaatccagagcttgttaaaggaccttggactcaagaggttctcttatcattttcatgttctgaaactttttttggttttcattttacgtaa

SEQ ID NO: 844 - protein, 115 aa, Arabidopsis thaliana
MKLIDWKDCALMTYTELILGFCNVLMLICRRTSGPMRRAKGGWTPEEDETLRRAVEKYKGKRWKKIAEFFPERTQVQCLHRWQKVLNPELVKGPWTQEVLLSFSCSETFFGFHFT

SEQ ID NO: 845 - DNA, 800 bp, Arabidopsis thaliana
gatcttttgatccaatcacaaggcaaagatccaatggacaataacaacaacaacaacaaccagcaaccaccaccaacctccgtctatccacctggctccgccgtcacaaccgtaatccctcctccaccatctggatctgcatcaatagtcaccggaggaggagcgacataccaccacctcctccagcaacaacagcaacagcttcaaatgttctggacataccagagacaagagatcgaacaggtaaacgatttcaaaaaccatcagctccctctagctcgtatcaaaaaaatcatgaaagctgatgaagatgtgcgtatgatctccgccgaagcaccgattctcttcgcgaaagcttgtgagcttttcattctcgaacttacgattagatcttggcttcacgctgaagagaacaaacgtcgtacgcttcagaaaaacgatatcgctgctgcgattactagaaccgatatcttcgatttccttgttgatattgttcctagggaagagatcaaggaagaggaagatgcagcatcggctcttggtggaggaggtatggttgctcccgccgcgagcggtgttccttattattatccaccgatgggacaaccggcggttcctggagggatgatgattggaagaccggcgatggatcctagcggtgtttatgctcagcctccttctcaggcatggcaaagcgtttggcagaattcagctggtggtggtgatgatgtgtcttatggaagtggaggaagtagcggccatggtaatctcgatagccaagggtaagtgaattctagtag

SEQ ID NO: 846 - protein, 250 aa, Arabidopsis thaliana
MDNNNNNNNQQPPPTSVYPPGSAVTTVIPPPPSGSASIVTGGGATYHHLLQQQQQQLQMFWTYQRQEIEQVNDFKNHQLPLARIKKIMKADEDVRMISAEAPILFAKACELFILELTIRSWLHAEENKRRTLQKNDIAAAITRTDIFDFLVDIVPREEIKEEEDAASALGGGGMVAPAASGVPYYYPPMGQPAVPGGMMIGRPAMDPSGVYAQPPSQAWQSVWQNSAGGGDDVSYGSGGSSGHGNLDSQG

SEQ ID NO: 847 - DNA, 1690 bp, Arabidopsis thaliana
ccattcctgacgtccgggatgacgcacaatcccactatccttcgcaagacccttcctctatataaggaagttcatttcatttggagaggacacgctgacaagctgactctagcagatctggtaccgatcactcccgtctttatcaaattcttcttcctcttacattttccctatccaatcgatctcacgcagatctgatcaatttctcatcaaatcatttagagatcaaaagaaaactatgaagaatagtaaatgtaacctcatagattcaaagctcgaagaacatcatcatctttgcggatcaaaacattgtcctggatgtggtcgcatgattcaagctgctactaaaccaaattgggttggattgccggcaggagtgaaattcgatccgacagatcaagaacttatagaacatttagaagcaaaagtgaagggaaaagaagaaaataagaaatggtcgtcgtctcatccacttatagatgaatttattcccaccattgatggagaagatggaatatgttacactcatcctcagaagcttccaggggtgacaagagatggcttgagcaaacacttcttccacaaaccatcaagagcttacacaaccggaacaagaaaacgacgtaaaataattcaaaccgatcacgactctgagttaaccggatcatcagaaaccaggtggcacaaaacgggcaaaacaagaccggttatgatcaacggtcaacaaagaggatgcaagaagatattagtactctacacaaacttcggcaagaatcgtcgaccggagaaaacaaattgggtgatgcatcaatatcatttagggattaatgaggaagagagagaaggagaacttgtggtctccaagatattttatcagacacaaccaagacagtgtgttagtaatactaattggtctgatcaccatggttccaaggacgtgatcggaattggtgtcggagatgagatttccagcgtagctgccacgttgcagagtcttggctccggtgacgtcgtttctagggttaatatgcatccccatacaagatcctttgatgaggggacagccgaagcttcaaagggaagagagaaccagcatgtgtctggcacgtgcgaggaagtacatgatgggatcataacatcatcaatgtcatctcatcatatgattcatgatcatcataatcaacatcatcaaatcggagatagaagagaatttcacatgtcatcatcatatcccatgacccctactatcacatcacaacatgagtcaatcttccatgttacaagtactatgccctttcagcggcagcaattaaggggtcggtcgtctggttcgggattagaagacctaattatgggttgtaccacagctacgtgtacagaagacaataatcacaaatgattaaattcgcaggagcattcagaagcaaaccctcagcgaaatgcagagtggttaacgtttccacaattctggaaccaagccgaatcagatgatcaaaaccgaagattttaacagaaccaaaaggaagcagagaaatcttgcaaaaagctcctgcttagctgttgatcaatgccggaaatgctgagctatgactgactagtctctgccatttaacttacaatatcaccagaggttgcgatgaatgttgattcgctcaaaggagagcggccgctctagacaggcctcgtaccg

SEQ ID NO: 848 - protein, 386 aa, Arabidopsis thaliana
MKNSKCNLIDSKLEEHHHLCGSKHCPGCGRMIQAATKPNWVGLPAGVKFDPTDQELIEHLEAKVKGKEENKKWSSSHPLIDEFIPTIDGEDGICYTHPQKLPGVTRDGLSKHFFHKPSRAYTTGTRKRRKIIQTDHDSELTGSSETRWHKTGKTRPVMINGQQRGCKKILVLYTNFGKNRRPEKTNWVMHQYHLGINEEEREGELVVSKIFYQTQPRQCVSNTNWSDHHGSKDVIGIGVGDEISSVAATLQSLGSGDVVSRVNMHPHTRSFDEGTAEASKGRENQHVSGTCEEVHDGIITSSMSSHHMIHDHHNQHHQIGDRREFHMSSSYPMTPTITSQHESIFHVTSTMPFQRQQLRGRSSGSGLEDLIMGCTTATCTEDNNHK

SEQ ID NO: 849 - DNA, 1130 bp, Arabidopsis thaliana
cagtactaattctgtgtgtgttaatggttctagttatggatgatgaagagagtaacaacgttgaaagatatgacgacgtcgtattgccagggtttaggttccatcccactgatgaagaactcgtaagtttctacttgaaacggaaggttttacacaaatctcttccctttgatctcatcaagaaagtcgacatttacaaatacgatccatgggacctcccaaagcttgcagcgatgggggaaaaagagtggtacttttattgtcctagagacaggaaataccgcaacagcacaagacctaaccgagtaactggaggtggcttctggaaagcaaccggaacagaccggcctatatactcattggactccactcgatgcatcggtttgaagaaatcacttgtgttctaccgtggtcgagctgctaaaggagtcaaaaccgattggatgatgcatgaatttcgtctcccttctctctctgactctcatcactcatcatatcccaattacaataacaagaagcaacaccttaacaataacaacaacagcaaggagcttccttcaaacgatgcttgggcgatatgtagaatatttaagaagacaaatgcagtatcctcacaaagatcaatcccacaatcttgggtttatccaacgattcctgacaacaatcaacagtcacacaacaacaccgcaactctcttagcttcatcagacgttctcagccacatatcaacaagacaaaactttattccttctccagtcaacgaacccgcaagcttcacagaatcagctgcttcttacttcgcgtctcagatgctcggagtcacgtacaatacagccagaaacaacggaacaggggatgctctgtttctgagaaacaatggaacaggggatgctctggttctgagcaacaatgagaataactacttcaacaacttgactggagggttgactcatgaggttccgaatgtaagatcaatggtgatggaggagactacggggagtgagatgtcggcgacgtcgtattccactaacaattaagatcatagtactattaacacttgaattagtgtagacgttgatcatcgctaatatgtattaatttttcttgtcttactataaacgaaaaaaaaa

SEQ ID NO: 850 - protein, 337 aa, Arabidopsis thaliana
MVLVMDDEESNNVERYDDVVLPGFRFHPTDEELVSFYLKRKVLHKSLPFDLIKKVDIYKYDPWDLPKLAAMGEKEWYFYCPRDRKYRNSTRPNRVTGGGFWKATGTDRPIYSLDSTRCIGLKKSLVFYRGRAAKGVKTDWMMHEFRLPSLSDSHHSSYPNYNNKKQHLNNNNNSKELPSNDAWAICRIFKKTNAVSSQRSIPQSWVYPTIPDNNQQSHNNTATLLASSDVLSHISTRQNFIPSPVNEPASFTESAASYFASQMLGVTYNTARNNGTGDALFLRNNGTGDALVLSNNENNYFNNLTGGLTHEVPNVRSMVMEETTGSEMSATSYSTNN

SEQ ID NO: 851 - DNA, 1095 bp, Arabidopsis thaliana
tccttcgcaagacccttcctctatataaggaagttcatttcatttggagaggacacgctgacaagctgactctagcagatctggtaccgtcgacaagaatgacttgattggtgttctaaagagatcgatgtagtgaagatgagtggcgaaggtaacttaggtaaggatcatgaagaagaaaacgaagcaccacttcctgggttcaggtttcatccgacggatgaagagcttttaggatactatcttcgaagaaaagtagagaacaaaaccatcaaactcgaacttatcaaacagatcgatatctataagtacgatccttgggatcttccaagagtgagcagcgtcggagaaaaggagtggtacttcttctgcatgagaggtaggaaatacaggaatagcgttcgaccaaaccgagtgaccggttcaggtttctggaaagccactggtattgataaaccggtttactccaatcttgactgtgttggtctcaagaaatctctggtttactatcttggttcagccggtaaaggcaccaaaaccgattggatgatgcatgaattccgcctcccctccaccacgaaaaccgactctccagctcaacaagcagaggtatggacactttgcagaatcttcaaacgagtcacatctcaaagaaacccaaccatcttaccaccaaaccgaaaaccggttatcactttaaccgacacttgttctaagaccagcagcttagattccgaccacacgagccaccgtacagtagattccatgtcccacgagccgccgcttccacagccacagaatccttattggaaccaacatatagttggttttaatcaaccgacatatactggtaatgataataacctcctgatgagtttctggaacggcaacggtggagatttcataggagactcagcaagttgggatgaacttagatctgttatagatggcaacactaaaccctagtaataaagtttccttttttcagctttgtacaaaaagataaaacaaacggcaaccgctctagacaggcctcgtaccgggatcctctagctagagctttcgtttcgtatcatcggtttcgacaacgttcgt

SEQ ID NO: 852 - protein, 275 aa, Arabidopsis thaliana
MSGEGNLGKDHEEENEAPLPGFRFHPTDEELLGYYLRRKVENKTIKLELIKQIDIYKYDPWDLPRVSSVGEKEWYFFCMRGRKYRNSVRPNRVTGSGFWKATGIDKPVYSNLDCVGLKKSLVYYLGSAGKGTKTDWMMHEFRLPSTTKTDSPAQQAEVWTLCRIFKRVTSQRNPTILPPNRKPVITLTDTCSKTSSLDSDHTSHRTVDSMSHEPPLPQPQNPYWNQHIVGFNQPTYTGNDNNLLMSFWNGNGGDFIGDSASWDELRSVIDGNTKP

SEQ ID NO: 853 - DNA, 2006 bp, Arabidopsis thaliana
ctcgtactttatcacctccgtcgttctataatactctcttccgtcaatcatatcatttgtcgacaatttcattctgatcagtttaaaaattgatccatggatgataatttaagcggcgaggaagaagattactattactcctccgatcaggaatctctcaacgggattgataatgatgaatccgtttcgatacctgtttcttcccgatcaaatactgtcaaggttattacgaaggaatcacttttggctgcacagagggaggatttgcggagagtgatggaattgttatcggttaaggagcaccatgctcggactcttcttatacattaccgatgggatgtggagaagttgtttgctgttcttgttgagaaagggaaagatagcttgttttctggtgctggtgttacacttcttgaaaaccaaagttgtgattcttccgtttctggttcttcttcgatgatgagttgtgatatctgcgtagaggatgtaccgggttatcagctgacaaggatggactgtggccatagcttttgcaataactgttggactgggcattttactgtaaagataaatgaaggtcagagcaaaaggattatatgcatggctcataagtgtaatgctatttgtgatgaagatgttgtcagggctctagttagtaaaagccaaccagatttagctgagaagtttgatcgttttcttcttgagtcgtatatcgaagataacaaaatggtgaagtggtgtccgagtactcctcattgtgggaatgccatacgtgttgaggatgacgagctctgtgaggttgaatgctcttgtggtttgcagttctgtttcagttgttcatctcaagctcactccccttgctcttgtgtgatgtgggaactatggagaaagaagtgctttgatgagtccgagactgttaattggataactgttcacacaaagccgtgtcccaaatgtcacaagcctgttgaaaagaatggtggatgcaatctcgtgacttgtctttgtcgacaatctttttgttggttgtgtggtgaagctactggaagggaccacacttgggctagaatctcgggtcatagttgtggtcggttccaagaagataaagagaaacaaatggagagagcgaaaagggatctcaagcggtatatgcattatcataaccgatacaaagcacatatcgactcctccaagctagaggctaagcttagtaataatattagtaaaaaggtgtctatttcagaaaagagggagttacaacttaaagacttcagctgggctaccaatggactccatcggttatttagatcaagacgagttctttcatattcataccctttcgcattttacatgtttggagatgagctgtttaaagatgagatgagctctgaggaaagagaaataaaacaaaatctgtttgaggatcagcagcagcagcttgaggctaatgttgagaaactttctaagttcttggaggaaccttttgatcaatttgctgatgataaggtcatgcagataaggattcaagtcatcaatttgtcagttgcggtcgatacactctgcgaaaatatgtatgaatgcattgagaatgacttgttgggttctctgcaacttggcatccacaacattactccatacagatcaaacggcatagaacgagcatctgatttttatagttcccagaattccaaggaagctgttggtcagtcttcggattgtggatggacgtccaggctcgatcaagctttggagtcagggaagtcggaagacacaagttgctcttccgggaagcgtgctagaatagacgaaagttacagaaacagccaaaccaccttactagatttaaacttgccagcggaagccattgagcggaaatgaacacttatccttcttcacctcccaataacaccctttttgtccaaataaagtgtgttacccggatatttatagctctaaacccaatcccctctgcttaatttgtcagtgaccttacctaaccctcttca

SEQ ID NO: 854 - protein, 593 aa, Arabidopsis thaliana
MDDNLSGEEEDYYYSSDQESLNGIDNDESVSIPVSSRSNTVKVITKESLLAAQREDLRRVMELLSVKEHHARTLLIHYRWDVEKLFAVLVEKGKDSLFSGAGVTLLENQSCDSSVSGSSSMMSCDICVEDVPGYQLTRMDCGHSFCNNCWTGHFTVKINEGQSKRIICMAHKCNAICDEDVVRALVSKSQPDLAEKFDRFLLESYIEDNKMVKWCPSTPHCGNAIRVEDDELCEVECSCGLQFCFSCSSQAHSPCSCVMWELWRKKCFDESETVNWITVHTKPCPKCHKPVEKNGGCNLVTCLCRQSFCWLCGEATGRDHTWARISGHSCGRFQEDKEKQMERAKRDLKRYMHYHNRYKAHIDSSKLEAKLSNNISKKVSISEKRELQLKDFSWATNGLHRLFRSRRVLSYSYPFAFYMFGDELFKDEMSSEEREIKQNLFEDQQQQLEANVEKLSKFLEEPFDQFADDKVMQIRIQVINLSVAVDTLCENMYECIENDLLGSLQLGIHNITPYRSNGIERASDFYSSQNSKEAVGQSSDCGWTSRLDQALESGKSEDTSCSSGKRARIDESYRNSQTTLLDLNLPAEAIERK

SEQ ID NO: 855 - DNA, 1818 bp, Arabidopsis thaliana; identical to SEQ ID NO: 365

SEQ ID NO: 856 - protein, 574 aa, Arabidopsis thaliana; identical to SEQ ID NO: 366

SEQ ID NO: 857 - DNA, 837 bp, Arabidopsis thaliana
gtaattacgatctacaacaagtgacatcgtcgtcgacgacgattcaagagaatatgaacttcctcgttccttttgaagaaaccaatgtcttaacctttttctcttcttcttcttcctcttctctttcttctccttctttccccattcacaactcttcctccactactactactcatgcacctctagggttttctaataatcttcagggtggaggacccttgggatcaaaggtggttaatgatgatcaggagaattttggaggtggaactaacaatgatgctcattctaattcttggtggagatcaaatagtggaagtggagatatgaagaacaaagtgaagataaggaggaaactaagagagccaagattctgtttccaaaccaaaagcgatgttgatgttcttgacgatggctacaaatggcgtaaatatggtcagaaagtcgtcaagaacagccttcaccccaggagttattacagatgcacacacaacaactgtagggtgaaaaagagagtggagcgactatcggaagattgtagaatggtgattactacttacgaaggtcgtcacaaccacattccctctgatgactccacttctcctgaccatgattgtctctcttccttttaacatctctttctatatatctatatatagacagttatatgtgcacatatagatgtgtgatatattgcatatttgatattgcatgtgtttttcaagagtatgtcatcagatgttatgcatatattcttgacttgttgcttatagtatacatatgtaataatatatattgacattggtagttcatttctgttcaaacaaaaaaaaaaaaaaa

SEQ ID NO: 858 - protein, 191 aa, Arabidopsis thaliana
MNFLVPFEETNVLTFFSSSSSSSLSSPSFPIHNSSSTTTTHAPLGFSNNLQGGGPLGSKVVNDDQENFGGGTNNDAHSNSWWRSNSGSGDMKNKVKIRRKLREPRFCFQTKSDVDVLDDGYKWRKYGQKVVKNSLHPRSYYRCTHNNCRVKKRVERLSEDCRMVITTYEGRHNHIPSDDSTSPDHDCLSSF

SEQ ID NO: 859 - DNA, 1171 bp, Arabidopsis thaliana
cttttttctcttctctcctcagagattcgaagctttttgtctcccctgagtaaccaaattcaatggccgacgattgggatctccacgccgtagtcagaggctgctcagccgtaagctcatcagctactaccaccgtatattcccccggcgtttcatctcacacaaaccctatattcaccgtcggacgacaaagtaatgccgtctccttcggagagattcgagatctctacacaccgttcacacaagaatctgtcgtctcttcgttttcttgtataaactacccagaagaacctagaaagccacagaaccagaaacgtcctctttctctctctgcttcttccggtagcgtcactagcaaacccagtggctccaatacctctagatctaaaagaagaaagatacagcataagaaagtgtgccatgtagcagcagaagctttaaactccgatgtctgggcatggcgaaagtacggacagaaacccatcaaaggttcaccatatccaagaggatactacagatgtagtacatcaaaaggttgtttagcccgtaaacaagtggagcgaaatagatccgacccgaagatgtttatcgtcacttacacggcggagcataatcatccagctccgacacaccgtaattctctcgccggaagcacacgtcagaaaccatccgatcaacagacgagtaaatctccgacgaccactattgctacttattcatcgtctccggtgacttcagccgacgaatttgttttgcctgttgaggatcatctagcggtgggagatcttgacggagaagaagatctgttatctttgtcggatacggtggttagcgatgatttcttcgatgggttagaggaattcgcagccggagatagcttttccgggaactcggctccggcgagttttgatctctcttgggttgtgaacagtgccgccactaccaccggaggaatatgattagattacgacggcttagaatactcttattaggacagatttataggattaaggaattattctcggagcatatgtaaaaataggataaaagaaaatgttctttgttactttttttcgggttttcttcctattgtttctaaacatcttagaaaaaatttaattgtatattccttaagctcgatacatcttgttttaaaaaaaaaaaaaaaaaa

SEQ ID NO: 860 - protein, 298 aa, Arabidopsis thaliana
MADDWDLHAVVRGCSAVSSSATTTVYSPGVSSHTNPIFTVGRQSNAVSFGEIRDLYTPFTQESVVSSFSCINYPEEPRKPQNQKRPLSLSASSGSVTSKPSGSNTSRSKRRKIQHKKVCHVAAEALNSDVWAWRKYGQKPIKGSPYPRGYYRCSTSKGCLARKQVERNRSDPKMFIVTYTAEHNHPAPTHRNSLAGSTRQKPSDQQTSKSPTTTIATYSSSPVTSADEFVLPVEDHLAVGDLDGEEDLLSLSDTVVSDDFFDGLEEFAAGDSFSGNSAPASFDLSWVVNSAATTTGGI

SEQ ID NO: 861 - DNA, 1320 bp, Arabidopsis thaliana
aaaaggtcttcttggccatggatacttgtgctctagtaatccatcagtctctgtctcgcatcaaactttctcctcccaaatcttcttcttcttcttcttctgctttctcccctgaatccttaccgatcagacggatcgagctgtgtttccgaggagctatatgtgccgccgtacaaagaaactacgaagaaacgacctcctccgtggaagaggcagaggaagatgatgagtcatcatcatcgtacggagaagtgaacaagatcattggaagccgaacggcgggggaaggagccatggagtaccttatcgagtggaaggacggccattctccgtcgtgggttccatcgagctacatcgcagcagacgtagtgtcggagtacgagacaccctggtggacggcagctagaaaagccgacgagcaggccctgtcacagctcctggaggaccgagacgtcgatgccgtggacgaaaacggccggacggctctgcttttcgtggcaggtctggggtcggacaagtgcgtaaggcttctggcggaggctggagccgatctcgaccaccgagacatgaggggaggcttgacggcgctgcacatggcggctggttacgtgaggccggaggtggtggaggcgctggtggagctgggagctgatattgaagtggaagacgagagagggttaacggcgttggaactagcgagggagattctgaagacgacgccgaaggggaatccgatgcagttcgggaggagaattgggttagagaaagtgatcaatgtcctggaaggacaagtgttcgagtacgccgaggtggatgagatcgtagagaaacgagggaaaggcaaagacgttgaatatctggtcagatggaaggacggtggagattgcgagtgggtgaaaggtgtacacgtggcggaagatgtggctaaggactacgaggatgggctggagtacgctgtagcggagagtgtgatcgggaagagggtgggagacgatgggaagaccatcgagtatcttgtcaaatggactgatatgtctgatgccacttgggagcctcaggacaatgtcgactctactcttgttctactctaccaacaacaacaaccaatgaatgaatgattgattttgatgattacattcttctcaatttgcttctttctcatatgtgttggttcatctgaccggttcggttggtacgtaccggtacattttcattttcttttaagatgtgatcttgatggtttttggccttttggggacactatttgattttatatccatgctttgaattttgcttccctttttggggagattcatgaaa

SEQ ID NO: 862 - protein, 366 aa, Arabidopsis thaliana
MDTCALVIHQSLSRIKLSPPKSSSSSSSAFSPESLPIRRIELCFRGAICAAVQRNYEETTSSVEEAEEDDESSSSYGEVNKIIGSRTAGEGAMEYLIEWKDGHSPSWVPSSYIAADVVSEYETPWWTAARKADEQALSQLLEDRDVDAVDENGRTALLFVAGLGSDKCVRLLAEAGADLDHRDMRGGLTALHMAAGYVRPEVVEALVELGADIEVEDERGLTALELAREILKTTPKGNPMQFGRRIGLEKVINVLEGQVFEYAEVDEIVEKRGKGKDVEYLVRWKDGGDCEWVKGVHVAEDVAKDYEDGLEYAVAESVIGKRVGDDGKTIEYLVKWTDMSDATWEPQDNVDSTLVLLYQQQQPMNE

SEQ ID NO: 863 - DNA, 657 bp, Arabidopsis thaliana
atgagaaaagtatgtgagcttgatatagagctaagtgaagaggaaagagacctactaacaactggatacaagaatgtcatggaggctaagagagtttcattgagagtaatatcatccattgaaaaaatggaagactcgaaaggaaacgaccaaaatgtgaaactgataaaaggacaacaagaaatggttaaatatgagtttttcaatgtttgtaatgacattttgtctctcattgattctcatctcataccatcaactactactaatgtcgaatcaattgtcctttttaacagagtgaaaggagattattttcgatatatggcagagtttggttctgatgctgaacgtaaagaaaatgcagataattctctagatgcatataaggttgcaatggaaatggcagagaatagtttagcacccaccaatatggttagacttggattggctttaaatttctcgatattcaattatgagatccataaatctattgaaagcgcatgtaaattggttaagaaagcttacgatgaagcaatcactgaactcgatggccttgacaagaatatatgcgaagagagcatgtatatcatagagatgcttaaatacaatctttctacgtggacttcaggcgatggtaatggtaataagacagacggttag

SEQ ID NO: 864 - protein, 218 aa, Arabidopsis thaliana
MRKVCELDIELSEEERDLLTTGYKNVMEAKRVSLRVISSIEKMEDSKGNDQNVKLIKGQQEMVKYEFFNVCNDILSLIDSHLIPSTTTNVESIVLFNRVKGDYFRYMAEFGSDAERKENADNSLDAYKVAMEMAENSLAPTNMVRLGLALNFSIFNYEIHKSIESACKLVKKAYDEAITELDGLDKNICEESMYIIEMLKYNLSTWTSGDGNGNKTDG

SEQ ID NO: 865 - DNA, 539 bp, Arabidopsis thaliana
ggaaccctaatttccgcaaattcactatgaagcgtattatcagaatctcattcaccgacgcagaagccaccgattcttctagcgacgaagacacggaggagcgtggaggagcatcccagactcggcgccgtgggaaacgcctcgttaaagagatcgtaatcgatccttccgattccgccgataaactcgatgtctgcaaaacacggttcaaaatcaggatcccggcggaatttctcaagacggcgaaaacggagaagaaatatcgtggagtgaggcagaggccgtgggggaagtgggtggcggagatcagatgtggaagaggagcttgtaaaggacgacgtgatcgtctctggctgggtacttttaacactgctgaggaagctgctctagcttatgataacgcttcaattaagctgattggacctcacgcgccgaccaattttggtttgccggcggagaatcaagaggataagacggtgattggagcttctgaggttgctagaggcgcgtgaagtggggttggtaatttagttgttagc

SEQ ID NO: 866 - protein, 161 aa, Arabidopsis thaliana
MKRIIRISFTDAEATDSSSDEDTEERGGASQTRRRGKRLVKEIVIDPSDSADKLDVCKTRFKIRIPAEFLKTAKTEKKYRGVRQRPWGKWVAEIRCGRGACKGRRDRLWLGTFNTAEEAALAYDNASIKLIGPHAPTNFGLPAENQEDKTVIGASEVARGA

SEQ ID NO: 867 - DNA, 828 bp, Arabidopsis thaliana
cctacaagaaatcaaacactagttctggtttctgcaaacatgtcatctacgaagcaagcaaagggaagaaaaacaaaggggaagcaaaagatcgagatgaagaaggtggagaactatggagataggatgattacgttctcaaaacgtaaaaccggaatttttaagaaaatgaacgagctcgtagcaatgtgtgacgttgaagtggctttcttgattttctctcaacccaagaagccctatacattcgcacatccgtctatgaagaaagtggctgaccggttaaagaacccttcgagacaagaaccattagagagagacgataccagacccctcgtcgaagcttataagaaacgaaggctccacgacctcgtaaaaaaaatggaggcgctcgaagaggagcttgcgatggatctagagaagttgaaactgttgaaggaatcgagaaatgaaaagaagttagataaaatgtggtggaactttccttcggaaggtttgagcgcgaaggagctgcagcaaaggtaccaagcgatgctcgagttacgtgataacttatgcgacaatatggctcacttacgattgggaaaagactgtggtggttcatcttctgttcgtgtgggacgtcgagtttctggtggtgttcgtctgttcgatcgtgaagcatgatcatacatattcatacttgatgatttaaatttctttgtatttgaactgctgattttaatactgcatgtatccatttgacgaagctcaatcgtctcgagtatatctctattatctaacagtattgagaaaaaaggagtttcagtaaaaaaaaaaaaaaaaaaaaaa

SEQ ID NO: 868 - protein, 207 aa, Arabidopsis thaliana
MSSTKQAKGRKTKGKQKIEMKKVENYGDRMITFSKRKTGIFKKMNELVAMCDVEVAFLIFSQPKKPYTFAHPSMKKVADRLKNPSRQEPLERDDTRPLVEAYKKRRLHDLVKKMEALEEELAMDLEKLKLLKESRNEKKLDKMWWNFPSEGLSAKELQQRYQAMLELRDNLCDNMAHLRLGKDCGGSSSVRVGRRVSGGVRLFDREA

SEQ ID NO: 869 - DNA, 1113 bp, Arabidopsis thaliana
atgggtcatcactcatgctgcaaccagcaaaaggtgaagagagggctttggtcaccggaagaagatgagaagcttattagatatatcacaactcatggctatggatgttggagtgaagtccctgaaaaagcagggcttcaaagatgtggaaaaagttgtagattgcgatggataaactatcttcgacctgatatcaggagaggaaggttctctccagaagaagagaaattgatcataagccttcatggagttgtgggaaacaggtgggctcatatagctagtcatttaccgggaagaacagataacgagattaaaaactattggaattcatggattaagaaaaagatacgaaaaccgcaccatcattacagtcgtcatcaaccgtcagtaactactgtgacattgaatgcggacactacatcgattgccactaccatcgaggcctctaccaccacaacatcgactatcgataacttacattttgacggtttcactgattctcctaaccaattaaatttcaccaatgatcaagaaactaatataaagattcaagaaacttttttctcccataaacctcctctcttcatggtagacacaacacttcctatcctagaaggaatgttctctgaaaacatcatcacaaacaataacaagaacaatgatcatgatgacacgcaaagaggaggaagagaaaatgtttgtgaacaagcatttctaacaactaacacggaagaatgggatatgaatcttcgtcagcaagagccgtttcaagttcctacactggcgtcacatgtgttcaacaactcttccaattcaaatattgacacggttataagttataatctaccggcgctaatagagggaaatgtcgataacatcgtccataatgaaaacagcaatgtccaagatggagaaatggcgtccacattcgaatgtttaaagaggcaagaactaagctatgatcaatgggacgattcacaacaatgctctaactttttcttttgggacaaccttaatataaacgtggaaggttcatctcttgttggaaaccaagacccatcaatgaatttgggatcatctgccttatcttcttctttcccttcttcgttttaa

SEQ ID NO: 870 - protein, 370 aa, Arabidopsis thaliana
MGHHSCCNQQKVKRGLWSPEEDEKLIRYITTHGYGCWSEVPEKAGLQRCGKSCRLRWINYLRPDIRRGRFSPEEEKLIISLHGVVGNRWAHIASHLPGRTDNEIKNYWNSWIKKKIRKPHHHYSRHQPSVTTVTLNADTTSIATTIEASTTTTSTIDNLHFDGFTDSPNQLNFTNDQETNIKIQETFFSHKPPLFMVDTTLPILEGMFSENIITNNNKNNDHDDTQRGGRENVCEQAFLTTNTEEWDMNLRQQEPFQVPTLASHVFNNSSNSNIDTVISYNLPALIEGNVDNIVHNENSNVQDGEMASTFECLKRQELSYDQWDDSQQCSNFFFWDNLNINVEGSSLVGNQDPSMNLGSSALSSSFPSSF

SEQ ID NO: 871 - DNA, 1470 bp, Arabidopsis thaliana
ctttggtcttggaagccaaatcaaacctttccttcaatcctcaaattttcgaaaattttctcttttgctttacgttctctcaattcttatttgtaagaaagtttgttcctttaatcaatcaaatcaaagagacttttgaagattgtttcccaatttgcgtcaatcgggatcgagtcaaatctgaaatcttctccactcatcatctgactataagacttaatcaagggactttttgttcgggtttggttttaaacgtcttggattcgaagtggttaaggtatggatgaaaataatggaggttcaagctcacttccacctttccttactaaaacatatgaaatggttgatgattcttcttctgactcggtcgttgcttggagcgaaaacaacaaaagcttcatcgtcaagaatccagcagagttttcaagagaccttcttccgagattcttcaagcataagaatttctcaagtttcatccgtcagcttaatacatatggttttcgaaaagtagatcctgagaaatgggaattcttgaatgatgattttgttagaggtcgaccttaccttatgaagaacattcatagacgaaaaccggttcatagccactcgttagtgaatctacaagcgcaaaatcctttgacggaatcagaaagacggagcatggaggatcagatagaaagactgaaaaatgagaaagaaggccttcttgcggagttacagaaccaagagcaagaacggaaagagtttgagctgcaagtaacgacattgaaagatcggttacaacatatggaacaacatcagaaatcaatagtggcatatgtttcacaggttttgggaaaaccaggactttcactaaacctcgaaaaccatgagagaagaaaaagaagatttcaagagaactctcttcctccaagcagttcacacatagaacaggtcgaaaagttagaatcttcgctaacgttttgggagaatcttgtatcggaatcatgcgagaagagcggtttgcagtcatcaagcatggatcatgatgcagctgagtcaagtctaagtattggcgatacacgacccaaatcatcgaagattgatatgaactcagagccgcccgttaccgttactgcgcctgctccaaaaacaggcgttaacgatgacttttgggaacaatgtttgacagagaaccctggatcaaccgagcaacaagaagttcagtcagagagaagagatgtcggtaatgataataatggtaataagattggaaatcaaaggacgtattggtggaattcagggaatgtaaataacattacagagaaagcttcttgacatgaatgaggtttttgtaaaatagttttcttttggttccactgagattattgtatgtgttcattatttattactctgtttctgtaaaaacaaatctctctattgtttgaggcaggagtgacataaatgcatatgcagaattggtttcaaaaa

SEQ ID NO: 872 - protein, 345 aa, Arabidopsis thaliana
MDENNGGSSSLPPFLTKTYEMVDDSSSDSVVAWSENNKSFIVKNPAEFSRDLLPRFFKHKNFSSFIRQLNTYGFRKVDPEKWEFLNDDFVRGRPYLMKNIHRRKPVHSHSLVNLQAQNPLTESERRSMEDQIERLKNEKEGLLAELQNQEQERKEFELQVTTLKDRLQHMEQHQKSIVAYVSQVLGKPGLSLNLENHERRKRRFQENSLPPSSSHIEQVEKLESSLTFWENLVSESCEKSGLQSSSMDHDAAESSLSIGDTRPKSSKIDMNSEPPVTVTAPAPKTGVNDDFWEQCLTENPGSTEQQEVQSERRDVGNDNNGNKIGNQRTYWWNSGNVNNITEKAS

SEQ ID NO: 873 - DNA, 960 bp, Arabidopsis thaliana
atggatcatcatcatcacatagcatcaagaaattcatcaacaacatcagaattaccatcattcgagccagcgtgccataacggtaatggtaacggttggatctatgacccaaatcaagttaggtacgatcaaagtagtgaccaacggctgtcaaagttgacggatcttgtaggcaagcactggtcaattgcaccaccgaataatcccgacatgaaccataaccttcatcatcacttcgatcatgatcattctcaaaacgacgacatttctatgtacagacaagccttggaggtgaaaaatgaggaagatctttgttacaataatggctcaagtggtggtggttccttgttccatgatcctatagaaagttctagaagtttccttgatataaggttaagtaggccattaacggatattaatccgtcatttaagccatgctttaaggccttaaacgtatccgagtttaacaagaaagaacatcaaacggcatctctggcagcagtgagactgggaacaacaaacgctggaaaaaagaagagatgtgaagaaatttccgatgaggtttcaaagaaggccaagtgcagtgagggctctacactttcgccagagaaggaactacccaaagccaaacttcgagacaagatcacgactctacagcaaattgtgtctccctttggaaagactgatactgcttctgtgcttcaagaggccatcacttacataaatttttatcaagagcaagttaagctgctaagcactccttatatgaagaattcatcaatgaaggatccatgggggggatgggacagagaagatcacaacaaaaggggaccgaagcatcttgatctaaggagtagagggctttgtttggttcctatttcatataccccaatcgcataccgcgataacagtgcaactgactactggaatcccacgtatagaggttctttgtatcgttag

SEQ ID NO: 874 - protein, 319 aa, Arabidopsis thaliana
MDHHHHIASRNSSTTSELPSFEPACHNGNGNGWIYDPNQVRYDQSSDQRLSKLTDLVGKHWSIAPPNNPDMNHNLHHHFDHDHSQNDDISMYRQALEVKNEEDLCYNNGSSGGGSLFHDPIESSRSFLDIRLSRPLTDINPSFKPCFKALNVSEFNKKEHQTASLAAVRLGTTNAGKKKRCEEISDEVSKKAKCSEGSTLSPEKELPKAKLRDKITTLQQIVSPFGKTDTASVLQEAITYINFYQEQVKLLSTPYMKNSSMKDPWGGWDREDHNKRGPKHLDLRSRGLCLVPISYTPIAYRDNSATDYWNPTYRGSLYR

SEQ ID NO: 875 - DNA, 903 bp, Arabidopsis thaliana
atgtcttccatcccaaataggttcaatatttatggtggtgataccacaaaccatcgtgaatcgcttcccatcgaaatgaatcacaactctcgaatggttcgatccatgttcattacatctgatcgcatgaatcatagagatttgttttcttctcctccttctttctcttcttatcaaaattcacatatctcttcatcttctgttgggtttaataattcacatatgacttatcatatgctgaaaagaaattatgattctgtttcccgtgctgattatttctctactaaagatcattctcattttactcaagtatctttcactcaaaccatcacaaataagtatactactattgttccttccaatatatttgacactgttcactatgatattggtcgtgtcaaacgtgccatagattttagaaatatttggaatcctaaatctcatcttccaaaaaaatttaataggcaatgcgagattttgaatcctacccctcttaatatcgtctttccgcaccaggattcagctgatcgtcaacatttagacattattttctcgtcatcaaagcacaaccatgttttccaagatggtcgatccttgaagaaaatttccgaaccaaccaatctgtttgaaaaatctaattcttatgattctcaagaagatgagaaaatcgatgcttatcaatatgatggtcgtacacatagtctaccgtatacgaaatacggtccatatacatgtcccaggtgtaacggtgtgtttgatacttctcaaaaatttgctgcacatatgttatctcactacaataatgagacggacaaagaaagagaccaaagatttcgtgcaagaaataaaaaacgatatcgtaagtttatggacagtcttaaaatatcaaaacagaagatatga

SEQ ID NO: 876 - protein, 300 aa, Arabidopsis thaliana
MSSIPNRFNIYGGDTTNHRESLPIEMNHNSRMVRSMFITSDRMNHRDLFSSPPSFSSYQNSHISSSSVGFNNSHMTYHMLKRNYDSVSRADYFSTKDHSHFTQVSFTQTITNKYTTIVPSNIFDTVHYDIGRVKRAIDFRNIWNPKSHLPKKFNRQCEILNPTPLNIVFPHQDSADRQHLDIIFSSSKHNHVFQDGRSLKKISEPTNLFEKSNSYDSQEDEKIDAYQYDGRTHSLPYTKYGPYTCPRCNGVFDTSQKFAAHMLSHYNNETDKERDQRFRARNKKRYRKFMDSLKISKQKI

SEQ ID NO: 877 - DNA, 2956 bp, Arabidopsis thaliana
tgcaatttctctcgaccaaaaccctaatttcaggtttggggttttccttctttcactgtcaattttgatgaaacttgtgattcagtgattagaatgaatgctaatgagcaaactcgatccgccaatggcattggcaatggcaatggtgagtctattcccgggattccagatgacttacggtgcaagagatcggatggtaaacagtggagatgcactgcaatgtccatggctgataagactgtttgtgagaagcactacatccaagcaaagaagcgggcggctaattctgctttcagggcgaaccagaagaaagcgaaaaggcgatcatcgttaggcgaaacagatacgtattcggaagggaagatggatgatttcgagttaccagtcaccagcattgaccactataataacggtcttgcctctgcttccaagagtaatggtagactagagaagagacataataaaagcctgatgcggtactcgcccgagacaccgatgatgaggagtttctctccacgtgttgcagtggatttgaatgatgacttgggtagagatgttgtaatgtttgaagagggctacagatcttataggacaccaccatctgttgctgttatggatccgacacgaaacagatcacaccaaagcaccagtcctatggaatactcagcagcaagcacagatgtgtctgcagagtctttgggggaaatctgccatcaatgccagagaaaagatagagagagaatcatttcttgcctcaaatgcaatcaaagagccttctgccacaattgtctatcggcaaggtactcggagatatcacttgaagaagtcgagaaagtttgccctgcatgtcgtggcttgtgtgattgcaaatcttgcctgcgttcagataatacaataaaggttcggatccgggaaatacccgttttggacaagttgcagtatctttatcgtctattatcagctgtcctaccagtcataaagcagatccatcttgaacaatgtatggaagttgaactagagaagaggcttcttgaagttgagattgatcttgtcagggcaagattgaaagcagatgagcagatgtgctgcaacgtgtgtcggataccagttgttgactactaccgtcactgtccgaactgctcatatgacctttgcctgagatgctgtcaagatctacgggaagagtcttcagtgacgattagtgggactaaccaaaacgtacaagatagaaaaggagctcccaaactaaaactaaacttttcatacaagtttcctgagtgggaagccaacggtgatgggagcatcccttgccctcctaaggagtatggaggctgcggttcacattctttgaatcttgcccgcattttcaagatgaattgggttgcaaagcttgtgaaaaatgctgaggagattgttagtggctgcaaattatctgatcttctgaaccctgatatgtgtgattcaagattctgcaaatttgctgagagagaagagagcggtgacaactacgtgtacagcccgtcgcttgaaacgattaaaactgatggagtagctaagtttgagcaacaatgggcagagggtcggcttgttactgtgaaaatggtacttgatgactcatcttgctctagatgggatcctgagactatttggagggatatagacgagctttcggacgagaaactgagagaacatgatccattcttgaaggccattaattgcttggatggtttagaggttgatgtaagacttggggagtttacaagagcatataaagatggaaagaaccaagagacaggtcttccgctattgtggaagttaaaggactggccgagcccaagtgcttccgaggagttcattttctaccaaagacctgagtttatcagaagttttccgtttctcgagtacattcatccccggttaggccttctgaatgttgcagccaagttacctcattactcgctccaaaacgattcaggtccaaagatttatgtgtcttgtgggacgtaccaagaaatcagtgctggcgattcattgactggtattcactacaacatgcgtgacatggtatacctattggtgcacacgtctgaagaaacaacattcgaaagggtgagaaaaacaaaacctgttccagaggaacctgaccagaagatgagcgaaaatgagtcacttcttagccctgagcagaaattaagggacggagagttacatgatctatcacttggtgaagccagtatggagaagaatgaacctgagttggcgttgactgtgaatccagagaacttaacggaaaacggtgacaacatggaatcttcttgcacatcttcatgtgcaggaggagcccagtgggatgtctttcgacgccaagacgtcccaaagttgtccgggtatttgcagagaacattccagaagcctgataatatccagactgattttgtaagccgtacctgctaattcaaataaatgaagtgtgtaaagtcttgtatgtggaatgattgagtttcctagtttgtttactctggtttcaggtgtcacgcccgttgtatgaaggattgtctttaaatgaacaccacaagagacaactaagagacgagtttggagttgagccatggacatttgagcaacatcgtggtgaggctatcttcattccggctggatgtccgttccaaatcactaatcttcagtcgaatattcaggtggcacttgacttcttgtgccctgaaagcgttggagagtcagcaagactagctgaagaaatccggtgtttaccaaacgaccacgaggcaaaacttcagattctagagattggaaagatatcattatacgcagctagctcagccattaaagaggttcagaaactggtcttggatccaaagtttggagcagagcttggatttgaagactctaacttaaccaaagcagtctctcacaacttagacgaggcaaccaagcggcc

SEQ ID NO: 878 - protein, 786 aa, Arabidopsis thaliana
MNANEQTRSANGIGNGNGESIPGIPDDLRCKRSDGKQWRCTAMSMADKTVCEKHYIQAKKRAANSAFRANQKKAKRRSSLGETDTYSEGKMDDFELPVTSIDHYNNGLASASKSNGRLEKRHNKSLMRYSPETPMMRSFSPRVAVDLNDDLGRDVVMFEEGYRSYRTPPSVAVMDPTRNRSHQSTSPMEYSAASTDVSAESLGEICHQCQRKDRERIISCLKCNQRAFCHNCLSARYSEISLEEVEKVCPACRGLCDCKSCLRSDNTIKVRIREIPVLDKLQYLYRLLSAVLPVIKQIHLEQCMEVELEKRLLEVEIDLVRARLKADEQMCCNVCRIPVVDYYRHCPNCSYDLCLRCCQDLREESSVTISGTNQNVQDRKGAPKLKLNFSYKFPEWEANGDGSIPCPPKEYGGCGSHSLNLARIFKMNWVAKLVKNAEEIVSGCKLSDLLNPDMCDSRFCKFAEREESGDNYVYSPSLETIKTDGVAKFEQQWAEGRLVTVKMVLDDSSCSRWDPETIWRDIDELSDEKLREHDPFLKAINCLDGLEVDVRLGEFTRAYKDGKNQETGLPLLWKLKDWPSPSASEEFIFYQRPEFIRSFPFLEYIHPRLGLLNVAAKLPHYSLQNDSGPKIYVSCGTYQEISAGDSLTGIHYNMRDMVYLLVHTSEETTFERVRKTKPVPEEPDQKMSENESLLSPEQKLRDGELHDLSLGEASMEKNEPELALTVNPENLTENGDNMESSCTSSCAGGAQWDVFRRQDVPKLSGYLQRTFQKPDNIQTDFVSRTC

SEQ ID NO: 879 - DNA, 1350 bp, Arabidopsis thaliana
caagaacccaaagatctctctctatttgtttgccttcttctttctttctgactcaaaccctcaaatcaattctcgcgattaagcaaaaccctagatttattctactcttcgaagtcgatttcaatggaaggttcctcgtcagccatcgcgaggaagacatgggagctagagaacaacattctcccagtggaaccaaccgattcagcctccgacagtatattccactacgacgacgcttcacaagccaaaatccagcaggagaagccatgggcctccgatcctaactacttcaagcgcgttcacatctcagcccttgctcttctcaagatggtggttcacgctcgctccggtggcacaatcgagatcatgggtcttatgcagggtaaaaccgagggtgatacaatcatcgttatggatgcttttgctttgcctgttgaaggtactgagactagggttaatgctcagtctgatgcctatgagtatatggttgaatactctcagaccagcaagctggctgggaggttggagaacgttgttggatggtatcactctcaccctgggtatggatgttggctctcgggtattgatgtttcgacacagatgcttaaccaacagtatcaggagccattcttagctgttgttattgatccaacaaggactgtttcggctggtaaggttgagattggggcattcagaacatatccagagggacataagatctcggatgatcatgtttctgagtatcagactatccctcttaacaagattgaggactttggtgtacattgcaaacagtactactcattggacatcacttatttcaagtcatctctcgatagtcaccttctggatctcctttggaacaagtactgggtgaacactctttcttcttccccactgttgggcaatggagactatgttgccgggcaaatatcagacttggctgagaagctcgagcaagcggagagtcagctcgctaactcccggtatggaggaattgcgccagccggtcaccaaaggaggaaagaggatgagcctcaactcgcgaagataactcgggatagtgcaaagataactgtcgagcaggtccatggactaatgtcacaggttatcaaagacatcttgttcaattccgctcgtcagtccaagaagtctgctgacgactcatcagatccagagcccatgattacatcgtgaagttggtctattcttttgttttttggctgcggaaattgactatcggtttgacccggtttatgaggcaatgcccattgttccctatatctctagtgtagtatctgcttcagacaaagatctttgggttattaaatgacattaacataaaaaaaa

SEQ ID NO: 880 - protein, 357 aa, Arabidopsis thaliana
MEGSSSAIARKTWELENNILPVEPTDSASDSIFHYDDASQAKIQQEKPWASDPNYFKRVHISALALLKMVVHARSGGTIEIMGLMQGKTEGDTIIVMDAFALPVEGTETRVNAQSDAYEYMVEYSQTSKLAGRLENVVGWYHSHPGYGCWLSGIDVSTQMLNQQYQEPFLAVVIDPTRTVSAGKVEIGAFRTYPEGHKISDDHVSEYQTIPLNKIEDFGVHCKQYYSLDITYFKSSLDSHLLDLLWNKYWVNTLSSSPLLGNGDYVAGQISDLAEKLEQAESQLANSRYGGIAPAGHQRRKEDEPQLAKITRDSAKITVEQVHGLMSQVIKDILFNSARQSKKSADDSSDPEPMITS

SEQ ID NO: 881 - DNA, 1501 bp, Arabidopsis thaliana
tttccctctccgaaacagaaattcaaaaacaaattcaacacgaaaacgatggcgtttcataacaatcactttaatcatttcaccgaccaacaacaacatcagcctcctcctccgccgcaacagcagcagcaacaacattttcaagaatcagcaccccctaattggctcctccgctccgacaacaacttcctcaatctccacacagctgccacagccgccgctacaagctccgattctccttcttccgccgccgctaaccagtggctctcacgatcctcatccttcctccaacgaggcaacaccgcaaacaacaacaacaacgaaacatccggtgacgtcatcgaagacgttcccggcggagaggagtcaatgatcggagagaagaaggaggcggagaggtggcagaatgcgagacacaaggcggagatactgtctcatccactatacgagcaacttttgtcggcacacgtggcgtgcctgaggatcgcaacgccggtggatcagcttccgaggatagacgcacagcttgctcagtctcaaaacgtcgtggctaagtactcaactttagaagccgctcaaggactcctcgccggcgatgacaaggagcttgaccacttcatgacgcattatgtactattgctttgctctttcaaagaacaactgcaacagcatgttcgtgttcatgcaatggaagctgttatggcctgttgggagattgaacagtcgcttcaaagttttacaggagtatctcctggtgaaggcacaggagcaacaatgtctgaggatgaagatgagcaagtagagagtgatgctcatttgtttgatggaagcttagatgggttagggtttggtcctctagttcccactgagagcgagagatctttgatggaacgagtcagacaagaactcaaacatgaactcaagcagggttacaaggagaaaattgtggacataagagaggagatactgaggaagagaagagctggaaaattaccaggagacaccacctctgttctcaaatcatggtggcaatctcattctaagtggccttaccctactgaggaagataaggcgaggttggtgcaggagacgggtttgcagctcaaacagataaacaattggttcatcaatcaaagaaagaggaattggcatagcaatccatcttcttctaccgtctcaaagaataaacgccgaagcaatgcaggtgaaaacagcggaagagaccgttgagatcaagcttgcatgtagagatccaaaagctttatagaaaggtggaggcatgaagacaaagaattcttacacaacaaacgtaggacgtaattttgtgccagtacatggtatggctttcatatttggtaatgattagggccacacaaaattaaaccccaaagcatgatttgtaatatgaggttttagatggactttatgataggatcgtcagtcttcactgccatctccattctccaccatcaatccatcattatatcttgtgaaaaaaaaa

SEQ ID NO: 882 - protein, 393 aa, Arabidopsis thaliana
MAFHNNHFNHFTDQQQHQPPPPPQQQQQQHFQESAPPNWLLRSDNNFLNLHTAATAAATSSDSPSSAAANQWLSRSSSFLQRGNTANNNNNETSGDVIEDVPGGEESMIGEKKEAERWQNARHKAEILSHPLYEQLLSAHVACLRIATPVDQLPRIDAQLAQSQNVVAKYSTLEAAQGLLAGDDKELDHFMTHYVLLLCSFKEQLQQHVRVHAMEAVMACWEIEQSLQSFTGVSPGEGTGATMSEDEDEQVESDAHLFDGSLDGLGFGPLVPTESERSLMERVRQELKHELKQGYKEKIVDIREEILRKRRAGKLPGDTTSVLKSWWQSHSKWPYPTEEDKARLVQETGLQLKQINNWFINQRKRNWHSNPSSSTVSKNKRRSNAGENSGRDR

SEQ ID NO: 883 - DNA, 1454 bp, Arabidopsis thaliana
cttcctcctttgctaataaacttttctttgaaccttacacgccttgttgatattactctcttaaatatatattttcgtacattaacacagacatatataaagctaaagatttcttcacgtaatgggtttgaaagatattgggtccaaattgccaccggggtttcgatttcatccaagtgatgaagagttggtttgtcattatctttgcaacaagattagggccaaatctgatcatggtgatgttgatgatgatgatgatgatgttgatgaagctttgaagggttctactgatcttgtggagattgacttgcatatctgtgagccatgggagcttcctgatgtggcaaagttaaacgcaaaggaatggtacttcttcagtttccgtgatcgaaagtatgctactggatatcgcacgaacagagcgacagtaagcggatactggaaagcaacaggaaaagatcgaacggtgatggatccacgtacaaggcaattggtagggatgagaaaaacactagtgttctacagaaacagagcaccaaatgggatcaaaactacttggatcatgcacgagttccgtcttgagtgtcctaacatcccacataaggaagactgggtcttgtgcagagtgttcaacaaaggcagagactcatcgctacaagacaataattattataacaatgataatcagacgcaaaggcttgaagttaatgacgctccggatcttaattacaacaatcagttgccacctttgctatcatcccctcctcataatcatcaacatgagaagatgaaaatccaagtttgtgatcagtgggagcagctaatgaagcagccttcaaggaccaccggccacccctatcatcaccattgtcatcatcaaaccatagcatgtggttgggagcagatgatgatcggttcgctgtcatcaccttcgagtcatggccctgatcacgagtcctttgctaaatttgctttaccgtcgacaataacaacagtgtcaacatcagtggtgatcatcatcagaattatgagaagattttgttgtcatcactagacatgacgagtttggatcacgacaagacatgtatgggatcatcatcggatggtggtatggtctctgatcttcacatggaatgtggtggattgagttttgagaccgaaaatatcctcgctttccaatgaacataattcaaggggttcgccaatttgttgattcgtgaattatacaaacattttatctatagatttatcacattatcaaacatgtaagttgtgtggcatttgggtatagggtttgtgtgattctaggtttttaggacgatgtatgttgttatatttagcgtgtttttaggatttattctcattttaaaattatatgaaaacccattactatgaatacaattagttttctttgttgtaaataatattttagattatcaaaaaaaaaaaaaaaa

SEQ ID NO: 884 - protein, 310 aa, Arabidopsis thaliana
MGLKDIGSKLPPGFRFHPSDEELVCHYLCNKIRAKSDHGDVDDDDDDVDEALKGSTDLVEIDLHICEPWELPDVAKLNAKEWYFFSFRDRKYATGYRTNRATVSGYWKATGKDRTVMDPRTRQLVGMRKTLVFYRNRAPNGIKTTWIMHEFRLECPNIPHKEDWVLCRVFNKGRDSSLQDNNYYNNDNQTQRLEVNDAPDLNYNNQLPPLLSSPPHNHQHEKMKIQVCDQWEQLMKQPSRTTGHPYHHHCHHQTIACGWEQMMIGSLSSPSSHGPDHESFAKFALPSTITTVSTSVVIIIRIMRRFCCHH

SEQ ID NO: 885 - DNA, 1254 bp, Arabidopsis thaliana
cacaaagatcctccgattcgaaggtttataaaaactcaaaatcgaatcttatccacaagaaaacaacaaggtacttttccaaaaatgaaggcggagttgaatttgccggcgggattccgatttcatccgacggacgaagagcttgtcaagttctatctttgccggagatgtgcgtcagaaccgattaacgttccggttatcgcagagattgacttgtacaaattcaatccatgggagcttccagaaatggcgttgtacggtgagaaagaatggtacttcttctcgcatagagaccggaaatacccaaacgggtcgagaccaaaccgggcagctggaaccggttattggaaagcgactggagctgataaaccgatcggaaaaccgaagacgttagggattaagaaagcactcgtcttctacgcaggaaaagctccgaaagggattaaaacgaattggattatgcacgagtatcgtctcgctaatgtcgatcgatctgcttctaccaacaagaagaacaacttaagacttgatgattgggttttgtgtcggatatacaataagaaaggaacaatggagaagtatttaccggcggcggctgagaaaccgacggaaaagatgagtacgtcggactcaagatgctcaagtcacgtgatttcaccggacgtcacgtgttctgataactgggaggttgagagtgagcccaaatggattaatctggaagacgcgttagaggcatttaatgatgacacgtccatgtttagttccattggtttgttgcaaaatgacgcctttgttcctcagtttcagtaccagtcctccgatttcgtcgattcgtttcaggacccgttcgagcagaaaccgttcttgaattggaattttgctcctcaagggtaaaaataatcggcaaaaagttgaagcttttcagagtcttcgatcaccggcattgtgtcggatcctgacccggagaccaagtcgggtcatacgattacataatcgggttattgagatttccacatttggatttccgagactaaccaacttaacggattctggggtaattggggggttttgcacaggtgaatcacactgagtcagcaagtttcgattttttggttttgttttgtaatgattgattaaatgtctaaagatatcacgaagtagattcagaagaactgtaaaagcaattgtgaccacccgttatgaatcataaatatattcaatgaagcatgagcttattttttttttaaaaaaaaa

SEQ ID NO: 886 - protein, 269 aa, Arabidopsis thaliana
MKAELNLPAGFRFHPTDEELVKFYLCRRCASEPINVPVIAEIDLYKFNPWELPEMALYGEKEWYFFSHRDRKYPNGSRPNRAAGTGYWKATGADKPIGKPKTLGIKKALVFYAGKAPKGIKTNWIMHEYRLANVDRSASTNKKNNLRLDDWVLCRIYNKKGTMEKYLPAAAEKPTEKMSTSDSRCSSHVISPDVTCSDNWEVESEPKWINLEDALEAFNDDTSMFSSIGLLQNDAFVPQFQYQSSDFVDSFQDPFEQKPFLNWNFAPQG

SEQ ID NO: 887 - DNA, 1413 bp, Arabidopsis thaliana
aatttgtttttttttcttttgtgggttcaattcgaattgttttccctgagactcaagttactgtgtcattactctgcattgagcaatgggtagcaacgaagaaggaaaccccactaacaactctgataagccatcgcaagctgctgctcctgagcagagtaatgttcatgtgtatcatcatgactgggctgctatgcaggcatattatgggcctagagttggtatacctcaatattacaactcaaatttggcgcctggtcatgctccaccgccttatatgtgggcgtctccatcgccaatgatggctccttatggagcaccatatccaccattttgccctcctggtggagtttatgctcatcctggtgttcaaatgggctcacaaccacaaggtcctgtttctcaatcagcatctggagttacaacccctttgaccattgatgcaccagctaattcagctggaaactcagatcatgggttcatgaaaaagctgaaagagttcgatggacttgcaatgtcaataagcaataacaaagttgggagtgctgaacatagcagcagtgaacataggagttctcagagctccgagaatgatggctctagcaatggtagtgatggtaatacaactgggggagaacaatctaggaggaaaagaaggcaacaaagatcaccaagcactggtgaaagaccctcatctcaaaacagtctgcctcttagaggtgaaaatgagaaacccgatgtgactatggggactcctgttatgcccacagcaatgagtttccaaaactctgctggcatgaacggtgtgccacagccatggaatgaaaaagaggttaaacgagagaagagaaaacagtcaaaccgagaatctgctaggaggtcaagactgaggaagcaggctgaaacagaacaactatctgtcaaagttgacgcattagtagctgagaacatgtctctgaggtctaaactaggccagctaaacaatgagtctgagaaactacggctggagaacgaagctatattggatcaactgaaagcgcaagcaacagggaaaacagagaacctgatctctcgagttgataagaacaactctgtatcaggtagcaaaactgtgcagcatcaactgttaaatgcaagtccgataaccgatcctgtcgcggctagctgaccgtggccgcaacaatgagaacccgatatttcttcctttgggttgtgattgtaacttaaaaggagactttttgtttttattcttagatttgtagctctctgcatagtgagcataaattgatgtaatatggtttaagagattcggtgttctctggtgtgtgctgcaaccacataattggtgatagataggtttagttatataagcaaatgtattagagataaggggagacatatttgatggtcttt

SEQ ID NO: 888 - protein, 360 aa, Arabidopsis thaliana
MGSNEEGNPTNNSDKPSQAAAPEQSNVHVYHHDWAAMQAYYGPRVGIPQYYNSNLAPGHAPPPYMWASPSPMMAPYGAPYPPFCPPGGVYAHPGVQMGSQPQGPVSQSASGVTTPLTIDAPANSAGNSDHGFMKKLKEFDGLAMSISNNKVGSAEHSSSEHRSSQSSENDGSSNGSDGNTTGGEQSRRKRRQQRSPSTGERPSSQNSLPLRGENEKPDVTMGTPVMPTAMSFQNSAGMNGVPQPWNEKEVKREKRKQSNRESARRSRLRKQAETEQLSVKVDALVAENMSLRSKLGQLNNESEKLRLENEAILDQLKAQATGKTENLISRVDKNNSVSGSKTVQHQLLNASPITDPVAAS

SEQ ID NO: 889 - DNA, 1292 bp, Arabidopsis thaliana
tcgacagacactctccctctctccatgcccataaaatctcaaagactgtttaaaaaaaaaaatgttttagctttaactgctttttttttgttgttggtgtaatgatatcacagagagaagaaagagaagagaagaagcagagagtgatgggagataagaaattgatttcatcttcttcttcttcctcggtttacgatactcgtatcaatcatcatcttcatcatcctccgtcttcttccgacgaaatctctcagtttctccggcatattttcgaccgttcttctcctttaccttcttactactccccggcgacgactacaacgacggcgtctttgattggtgtgcacgggagcggtgacccacatgcagataactcgagaagtctcgtttctcatcatccaccgtcagattctgtgcttatgtcgaaacgtgtcggagatttctctgaggttttaatcggcggaggatcaggctcagccgccgcgtgttttggtttctccggtggtggtaataataacaacgttcaaggaaatagctctgggactcgagtatcgtcttcttccgttggagctagtggcaacgagacagatgagtatgactgtgaaagcgaggaaggaggagaagctgtagttgatgaagctccctcttccaagtcaggtccttcttctcgtagttcatctaaaagatgcagagctgctgaagttcataatctctctgagaagaggaggagaagtagaattaatgaaaaaatgaaagctttacaaagtctcatccctaattcaaataagacggataaggcttcaatgcttgatgaagccattgagtatctgaaacagcttcagctccaagttcagatgttgactatgagaaatggaataaacttgcatcctttgtgtttacctggaactacattacacccattgcaactctctcagattcgaccccctgaagcaaccaatgatcctctgcttaatcataccaatcagtttgcttcgacttctaatgcaccggaaatgatcaatactgtggcttcttcatacgctttggaaccttctattcgcagtcactttggacctttccctctccttacttcacccgtggagatgagtcgggaaggtgggttaactcatccaaggttgaacattggtcattccaacgcaaacataaccggggaacaagctctgtttgatggacaacctgacctaaaagatcgaattacttgaacagtgtcccaacttcgggatctctatgtgttcttgtttcttagaacgcaagccataaagctgtctgac

SEQ ID NO: 890 - protein, 373 aa, Arabidopsis thaliana
MISQREEREEKKQRVMGDKKLISSSSSSSVYDTRINHHLHHPPSSSDEISQFLRHIFDRSSPLPSYYSPATTTTTASLIGVHGSGDPHADNSRSLVSHHPPSDSVLMSKRVGDFSEVLIGGGSGSAAACFGFSGGGNNNNVQGNSSGTRVSSSSVGASGNETDEYDCESEEGGEAVVDEAPSSKSGPSSRSSSKRCRAAEVHNLSEKRRRSRINEKMKALQSLIPNSNKTDKASMLDEAIEYLKQLQLQVQMLTMRNGINLHPLCLPGTTLHPLQLSQIRPPEATNDPLLNHTNQFASTSNAPEMINTVASSYALEPSIRSHFGPFPLLTSPVEMSREGGLTHPRLNIGHSNANITGEQALFDGQPDLKDRIT

SEQ ID NO: 891 - DNA, 1120 bp, Arabidopsis thaliana
gtatttcttacaataaacgaccaaaaagttaatacaagaaatagaaacggtgtaggaagctactatgacggcaattccaaacgtcgtcgatattgaatcttcttcctcttcgctttgtcaagagacggcaacggagaccgtcaccgttgaaagaggctcgtctgattcatcttcaaagccagacgacgtcgttttactaatcaaggaagaggaggatgacgccgttaacttgtcacttggtttttggaaattgcacgagataggtttaataacaccgttcttgagaaagacgtttgagatcgtcgatgacaaagtaacagacccggttgtatcatggagcccgacccgtaaaagctttatcatttgggattcttacgagttctcagagaatctacttcccaaatacttcaagcacaagaacttctccagttttattcgtcagcttaactcttacggttttaaaaaggtcgattcagataggtgggaatttgctaacgaagggtttcaaggagggaagaaacatttgcttaagaacatcaagaggagaagcaaaaacactaaatgttgtaacaaggaagcgagtaccaccacgacagagactgaggttgagtcattgaaggaggaacagagtccaatgagattggagatgttgaagctgaaacaacaacaagaagaatctcaacatcagatggtcactgtgcaggagaagatccacggagttgataccgaacaacagcatatgcttagtttctttgcaaagttggctaaagatcaaagatttgtagagagactggtgaagaagagaaagatgaaaatacagagagagctagaagcagctgaattcgtgaagaagctcaagttgcttcaggatcaagaaactcaaaagaacttgttagatgtagaaagagaatttatggccatggctgcaacagaacacaatcccgagcctgacattttggtgaacaatcaaagcgggaatacgagatgtcagcttaactcagaggacctacttgttgacggtggctcaatggatgtaaatgggaggatagagatagagtagagcaaaaccggtaacatagcaatagagaaggtaccaaatcccaaggcttgagatccgaat

SEQ ID NO: 892 - protein, 331 aa, Arabidopsis thaliana
MTAIPNVVDIESSSSSLCQETATETVTVERGSSDSSSKPDDVVLLIKEEEDDAVNLSLGFWKLHEIGLITPFLRKTFEIVDDKVTDPVVSWSPTRKSFIIWDSYEFSENLLPKYFKHKNFSSFIRQLNSYGFKKVDSDRWEFANEGFQGGKKHLLKNIKRRSKNTKCCNKEASTTTTETEVESLKEEQSPMRLEMLKLKQQQEESQHQMVTVQEKIHGVDTEQQHMLSFFAKLAKDQRFVERLVKKRKMKIQRELEAAEFVKKLKLLQDQETQKNLLDVEREFMAMAATEHNPEPDILVNNQSGNTRCQLNSEDLLVDGGSMDVNGRIEIE

SEQ ID NO: 893 - DNA, 2214 bp, Arabidopsis thaliana
aactcgagaattcttcatttcttttaaatcttagaatctcgagtttttgtataaatcgattctaatttttcctttgtacattgttttatatatacataaaacacacaaatcgggtatgggggaatttgggttttaagatagcgtgatctgtaataataagtggttcgcgatcgtgatcaagaaactggtggctgatagtgatatgcatatttgagagatggtgttcaagagaaagttagattgcctttccgtgggatttgattttcccaacattcccagagctcctcgttcatgcaggaggaaggttctaaacaagaggattgatcatgatgatgataacactcagatctgtgcaattgacttactagctttggctggaaagattctacaggaaagcgagagttcctctgcgtcttctaatgcatttgaagaaattaagcaagagaaagtagaaaattgcaagactattaaatctgagtcttctgaccaaggaaactctgtgtcaaagcctacttatgatatctctactgagaagtgtgtggtgaacagttgtttttcatttccggatagtgacggcgttttggagcggactccgatgtctgattacaagaagattcatggtttgatggatgtagggtgtgaaaacaagaatgtaaataatgggttcgagcaaggagaagcaaccgatcgcgtgggtgatggaggcttagtcactgatacttgcaacttagaggatgcaactgcgttaggtctgcagtttccgaaatcagtctgtgtgggtggtgatttaaaatcaccatccaccttggatatgacccctaatggttcctatgctagacatgggaaccatactaacctaggtagaaaagatgatgatgaaaaattctatagttaccataaacttagcaataaatttaagtcgtataggtctccaacaattcgaagaataagaaagtccatgtcgtccaaatactggaaacaagttccaaaagattttggatacagtagagctgatgtgggtgtgaagactctttatcgcaaaagaaaatcatgttatggttacaacgcatggcagcgtgagatcatttataagagaagaagatcacctgacagaagctcggtcgtaacttctgatggaggactcagtagtggaagtgtttccaagttacccaagaagggagatacagtaaagctaagcattaagtcctttaggattccagagctttttattgaagttccagaaactgcaacagtaggatcactaaagaggactgtgatggaggctgtcagtgttttactcagcggaggaatacgtgttggggtgttaatgcatgggaagaaggttagagatgaaaggaaaactctgtcccagactgggatctcatgtgatgaaaatctagacaaccttgggttcaccttggagcctagtcccagcaaagttcccctacctttgtgttctgaagatcctgctgtgccaaccgaccctacaagtttgtctgaacggtctgcggcgtctcctatgctagattctggaattccacatgcagatgacgtgattgattcaagaaatattgtggacagtaacctcgaattagttccatatcagggtgacatatctgttgatgaaccttcatcagattcaaaagagcttgtcccacttccagagttggaagtcaaggcgcttgccatagttccgttgaaccagaaacctaagcgtactgagctagcccagaggagaactaggagacccttctctgtgacagaggtagaagctcttgtacaagcagttgaggaactcgggactggaagatggcgtgatgtaaaattgcgtgctttcgaggatgcagatcatcggacttacgtggacttgaaggacaaatggaagacgctagttcacacagcaagtatatccccacagcaacgaagaggagagccggtgccacaagaactgctagacagagtcttgagggcatacgggtattggtcgcagcaccaaggaaaacatcaggcgagaggagcgtccaaagatccagacatgaacagaggtggagcttttgaatcaggtgtttcagtgtaaaaaaggaggtacgcattggtgggtgggtgtacagaagcaaacaacacaataaatggacaactcaatttctgcaaagtttaattgtctttatttctcgtttttttttttttttctcctacatacacttttttttttct

SEQ ID NO: 894 - protein, 619 aa, Arabidopsis thaliana
MVFKRKLDCLSVGFDFPNIPRAPRSCRRKVLNKRIDHDDDNTQICAIDLLALAGKILQESESSSASSNAFEEIKQEKVENCKTIKSESSDQGNSVSKPTYDISTEKCVVNSCFSFPDSDGVLERTPMSDYKKIHGLMDVGCENKNVNNGFEQGEATDRVGDGGLVTDTCNLEDATALGLQFPKSVCVGGDLKSPSTLDMTPNGSYARHGNHTNLGRKDDDEKFYSYHKLSNKFKSYRSPTIRRIRKSMSSKYWKQVPKDFGYSRADVGVKTLYRKRKSCYGYNAWQREIIYKRRRSPDRSSVVTSDGGLSSGSVSKLPKKGDTVKLSIKSFRIPELFIEVPETATVGSLKRTVMEAVSVLLSGGIRVGVLMHGKKVRDERKTLSQTGISCDENLDNLGFTLEPSPSKVPLPLCSEDPAVPTDPTSLSERSAASPMLDSGIPHADDVIDSRNIVDSNLELVPYQGDISVDEPSSDSKELVPLPELEVKALAIVPLNQKPKRTELAQRRTRRPFSVTEVEALVQAVEELGTGRWRDVKLRAFEDADHRTYVDLKDKWKTLVHTASISPQQRRGEPVPQELLDRVLRAYGYWSQHQGKHQARGASKDPDMNRGGAFESGVSV

SEQ ID NO: 895 - DNA, 1137 bp, Arabidopsis thaliana
tataacaattccttccaacaatgtcattgagtcagccaataacacggaccgatagtgcacccaatggagcatttaggacttttggtctctactggtgctaccattgtgatcgtatggtcagaattgcatcctctaacccatcagagatcgcctgtcctcgatgtttgaggcaatttgtcgttgagattgaaacgagacaacggcctcggtttactttcaaccatgctactccgccttttgatgcttctcctgaggctcgtcttctcgaagctctctcgctcatgtttgagcctgcaaccataggtaggtttggtgcagacccatttcttagggcaagatccagaaacatcttggaacctgaatcaagaccccgaccgcaacatcgaagacgacacagccttgacaatgttaacaatggtggtttacctctaccaagaagaacatatgttattctccggcccaataatccgactagtccactcggaaacataattgcgccaccaaatcaagcaccaccacggcatgtgaactcacatgattactttactggagcatcaagcttagagcagctgattgaacaactaacacaagacgataggcctggaccaccacctgcgtcagaacccaccattaattccctaccatctgtgaaaataacaccacaacatctaactaacgacatgtcccaatgcacagtgtgcatggaagaattcattgttggtggggacgcaacggaattaccatgtaaacatatttaccataaagattgtatagtcccgtggcttaggcttaacaattcttgccctatctgccgccgtgacctgccacttgtcaacaccgttgctgaatctcgagaaaggagcaatcctattagacaagacatgcctgaaagaaggcgtccaaggtggatgcaactcggtaacatttggccatttagagcaagataccaaagggttagtccagaagaaacagcaaaccagaatcctcgagataacaggagctaactctgaatattccatgggaaataaaaatcgtgactatctatatgtatagactctatgagacattgtctatttgaatgtgcatgtatatctcagaaataaactcaagcgaaacatatttaacgactaaaaaaaa

SEQ ID NO: 896 - protein, 327 aa, Arabidopsis thaliana
MSLSQPITRTDSAPNGAFRTFGLYWCYHCDRMVRIASSNPSEIACPRCLRQFVVEIETRQRPRFTFNHATPPFDASPEARLLEALSLMFEPATIGRFGADPFLRARSRNILEPESRPRPQHRRRHSLDNVNNGGLPLPRRTYVILRPNNPTSPLGNIIAPPNQAPPRHVNSHDYFTGASSLEQLIEQLTQDDRPGPPPASEPTINSLPSVKITPQHLTNDMSQCTVCMEEFIVGGDATELPCKHIYHKDCIVPWLRLNNSCPICRRDLPLVNTVAESRERSNPIRQDMPERRRPRWMQLGNIWPFRARYQRVSPEETANQNPRDNRS

SEQ ID NO: 897 - DNA, 1200 bp, Arabidopsis thaliana
atgtcaaaatctatgagcatatcagtgaacggacaatctcaagtgcctcctgggtttaggtttcatccgaccgaggaagagctgttgcagtattatctccggaagaaagttaatagcatcgagatcgatcttgatgtcattcgcgacgttgatctcaacaagctcgagccttgggacattcaagagatgtgtaaaataggaacaacgccacaaaacgactggtatttctttagccacaaggacaaaaaatatccgacgggaacgagaactaacagagccactgcggctggattttggaaagcaactggccgcgacaagatcatatatagcaatggccgtagaattgggatgagaaagactcttgttttctacaaaggccgagctcctcacggccaaaaatctgattggatcatgcatgaatatagactcgatgacaacattatttcccccgaggatgtcaccgttcatgaggtcgtgagtattataggggaagcatcacaagacgaaggatgggtggtgtgtcgtattttcaagaagaagaatcttcacaaaaccctaaacagtcccgtcggaggagcttccctgagcggcggcggagatacgccgaagacgacatcatctcagatcttcaacgaggatactctcgaccaatttcttgaacttatggggagatcttgtaaagaagagctaaatcttgaccctttcatgaaactcccaaacctcgaaagccctaacagtcaggcaatcaacaactgccacgtaagctctcccgacactaatcataatatccacgtcagcaacgtggtcgacactagctttgttactagctgggcggctttagaccgcctcgtggcctcgcagcttaacggacccacatcatattcaattacagccgtcaatgagagccacgtgggccatgatcatctcgctttgccttccgtccgatctccgtaccccagcctaaaccggtccgcttcgtaccacgccggtttaacacaggaatatacaccggagatggagctatggaatacgacgacgtcgtctctatcgtcatcgcctggcccattttgtcacgtgtcgaatgttttgctgcttgtttgtctccttcgtctgcagcttcagttctggccgttccaaccatggcagaggcaggttcatttcgatctttcatcgcctcagatgcagatctctctccattga

SEQ ID NO: 898 - protein, 399 aa, Arabidopsis thaliana
MSKSMSISVNGQSQVPPGFRFHPTEEELLQYYLRKKVNSIEIDLDVIRDVDLNKLEPWDIQEMCKIGTTPQNDWYFFSHKDKKYPTGTRTNRATAAGFWKATGRDKIIYSNGRRIGMRKTLVFYKGRAPHGQKSDWIMHEYRLDDNIISPEDVTVHEVVSIIGEASQDEGWVVCRIFKKKNLHKTLNSPVGGASLSGGGDTPKTTSSQIFNEDTLDQFLELMGRSCKEELNLDPFMKLPNLESPNSQAINNCHVSSPDTNHNIHVSNVVDTSFVTSWAALDRLVASQLNGPTSYSITAVNESHVGHDHLALPSVRSPYPSLNRSASYHAGLTQEYTPEMELWNTTTSSLSSSPGPFCHVSNVLLLVCLLRLQLQFWPFQPWQRQVHFDLSSPQMQISLH

SEQ ID NO: 899 - DNA, 1236 bp, Arabidopsis thaliana
tatccttcgcaagacccttcctctatataaggaagttcatttcatttggagaggacacgctgacaagctgactctagcttatctggtaccgtcgacctcattcttgcgtttgatctttctttctctagatcccatatttttcttgatcaatttagtttcattatggaggaagatgcagcttttgatctactcaaagccgaactcttaaacgcagaagacgatgcaataatctcacgttatctgaagcgtatggtcgtcaacggagactcatggcctgatcacttcatcgaagacgcagacgtgttcaacaagaatccaaatgtggagttcgatgctgagagccctagcttcgtgatagttaaacctcgaacagaggcttgtggtaaaaccgatggatgtgaaactggttgctggaggatcatgggtcgtgataaaccgataaaatcgacggagactgtgaagattcaagggttcaagaagattctcaagttctgcctaaagaggaaacctagaggatacaagagaagttgggtaatggaagagtataggcttaccaataacttgaactggaagcaagatcatgtgatttgcaagattcggtttatgtttgaagctgaaatcagtttcttgctagccaagcatttctacactacatcagaatcacttcctcgaaatgagctgttgccagcttacggattcctttcatcagataagcaattggaggatgtatcttatccggtgacgataatgacttctgaaggaaacgattggcctagctacgttaccaacaatgtgtattgtctgcatccattggagctcgttgatcttcaagatcggatgtttaatgattacggaacctgcatcttcgctaacaagacttgtggtaaaaccgatagatgcattaatggtggttactggaaaattttgcaccgtgataggctgatcaagtcaaagtccgggatagttattggtttcaagaaggtgtttaagtttcatgaaacggagaaagaaagatacttctgtggtggagaagatgtgaaggtaacttggactctagaagagtataggcttagcgtgaagcagaataaattcttgtgcgttatcaagtttacttatgataactaagaatcttttctttggattttatgatcatcttagtatcgcgaccgctctagacaggcctcgtaccggatcctctagctagagctttcgttcgtatcatcggtttcgacaacg

SEQ ID NO: 900 - protein, 320 aa, Arabidopsis thaliana
MEEDAAFDLLKAELLNAEDDAIISRYLKRMVVNGDSWPDHFIEDADVFNKNPNVEFDAESPSFVIVKPRTEACGKTDGCETGCWRIMGRDKPIKSTETVKIQGFKKILKFCLKRKPRGYKRSWVMEEYRLTNNLNWKQDHVICKIRFMFEAEISFLLAKHFYTTSESLPRNELLPAYGFLSSDKQLEDVSYPVTIMTSEGNDWPSYVTNNVYCLHPLELVDLQDRMFNDYGTCIFANKTCGKTDRCINGGYWKILHRDRLIKSKSGIVIGFKKVFKFHETEKERYFCGGEDVKVTWTLEEYRLSVKQNKFLCVIKFTYDN

SEQ ID NO: 901 - DNA, 1535 bp, Arabidopsis thaliana
gaaaacagtcttctcttctccgatcccaaaaacgcaggaaaacaatgtcgtttaacagctcccacctccttcctccacaagaagaccttcctctccgacacttcaccgatcaatcacagcaacctccgccgcagcgtcacttctctgaaacaccttcgcttgtcaccgccagtttcctcaacctccctaccacccttaccactgcggattccgatctcgctcctccgcaccgcaacggagacaattccgttgctgatacaaacccacgctggctctcctttcattcggagatgcaaaatactggagaagtacgttctgaagttatcgacggagtcaacgccgatggtgaaacgatactcggcgttgtaggaggtgaagattggcggagtgctagctataaggcggcgattttaagacatccgatgtacgagcagcttcttgcggctcacgtggcttgccttagggttgcgactcccgttgaccagattccgaggatcgatgctcagctcagtcagttgcataccgtcgccgcgaaatactccactcttggtgtggttgttgacaacaaggaacttgatcatttcatgtcacattatgttgtcttgttatgttcatttaaagaacaactccaacaccacgtttgtgtccatgcaatggaagccattacggcttgttgggagattgaacaatcactgcaatccctaactggagtttctccaagtgaaagtaatggtaagacaatgtcggatgatgaagatgataatcaagtagagagcgaggtgaacatgtttgatggaagtttggacggttcagattgcttgatggggtttggtcctcttgttccaaccgagagagagagatctttgatggaacgtgtgaagaaagaactgaagcatgagcttaaacagggtttcaaagagaagattgtggacataagagaagagataatgaggaagagaagggcgggaaagttgccaggagatacgacttctgtactcaaagaatggtggcgaactcactcgaaatggccatacccaactgaggaagataaggcaaaactggttcaagaaaccggtttgcagttgaaacagatcaacaattggttcatcaaccagaggaaaagaaactggaacagcaactcttccacgtcatctactctcaccaagaacaaacgtaaacggaccgggaagtcgtaggtgacatagcggctaactagaggatggttctttgccatgtgaattcttgggaaccgtatatgaaagaaacgaatccggttctatgctcgtacagagtgtgttatttgtatagtggataccggttagcctatgaaaccggattctggagtccaaattgttgtttgtaacgacttagtagtttttggaagtgatctgtttcgttggtttgcgtcttgtaacgaacgcttaagcaagtgtgggttttttcttgtaaagtgtcaatatgttcgtttgtaatgaatgtatcaagcaatatttatcataattaaactagcttgaaatgtaaaaaaaaaaaaaaaa

SEQ ID NO: 902 - protein, 383 aa, Arabidopsis thaliana
MSFNSSHLLPPQEDLPLRHFTDQSQQPPPQRHFSETPSLVTASFLNLPTTLTTADSDLAPPHRNGDNSVADTNPRWLSFHSEMQNTGEVRSEVIDGVNADGETILGVVGGEDWRSASYKAAILRHPMYEQLLAAHVACLRVATPVDQIPRIDAQLSQLHTVAAKYSTLGVVVDNKELDHFMSHYVVLLCSFKEQLQHHVCVHAMEAITACWEIEQSLQSLTGVSPSESNGKTMSDDEDDNQVESEVNMFDGSLDGSDCLMGFGPLVPTERERSLMERVKKELKHELKQGFKEKIVDIREEIMRKRRAGKLPGDTTSVLKEWWRTHSKWPYPTEEDKAKLVQETGLQLKQINNWFINQRKRNWNSNSSTSSTLTKNKRKRTGKS

SEQ ID NO: 903 - DNA, 570 bp, Arabidopsis thaliana
atgaaagtagcagatatgcaggaccagctggtgtgtcatggttgtaggaatttattgatgtatcctagaggagcatctaatgtgcgttgtgcgttatgtaacactatcaacatggttcctcctcctcctccacctcacgacatggcacacattatatgtggtggttgtagaacaatgcttatgtatacgcgtggggctagtagcgtaagatgctcttgctgtcaaactacgaaccttgtgccagcgcactccaatcaggttgcccatgctccttccagtcaggttgcgcagatcaattgtgggcattgtcggacgaccctcatgtatccttacggtgcatcatccgtcaaatgcgctgtttgtcaattcgtaactaacgttaatatgagcaatggaagggtacctctcccaactaaccggccaaatggaacagcttgtcccccctctacatcaacttcaacaccaccctctcagacccaaaccgttgttgtagaaaaccccatgtccgttgatgaaagcggaaagttggtgagcaatgttgttgttggagtgacaactgacaaaaagtaa

SEQ ID NO: 904 - protein, 189 aa, Arabidopsis thaliana
MKVADMQDQLVCHGCRNLLMYPRGASNVRCALCNTINMVPPPPPPHDMAHIICGGCRTMLMYTRGASSVRCSCCQTTNLVPAHSNQVAHAPSSQVAQINCGHCRTTLMYPYGASSVKCAVCQFVTNVNMSNGRVPLPTNRPNGTACPPSTSTSTPPSQTQTVVVENPMSVDESGKLVSNVVVGVTTDKK

SEQ ID NO: 905 - DNA, 732 bp, Arabidopsis thaliana
atggaagggaacttcttcatcaggtctgatgctcaacgagcacatgacaatggcttcatagccaaacaaaaacctaatctcaccacggctccaacagcaggtcaagctaatgaaagtggctgttttgactgcaacatctgtttagacacagcccatgatccggtggtcactctctgcgggcaccttttctgctggccttgcatttacaagtggttacatgttcagttatcttctgtctccgttgatcagcaccagaacaattgccctgtttgtaaatccaacattactatcacctctttggttcctctctatggaagaggcatgtcttcgccttcttccacgtttggctccaagaaacaagacgcactgtccactgacataccccgcagacctgctccatcagccttacgcaatccgattacctcagcatcatctctgaacccaagcttgcaacatcaaactctgtctccttcatttcataatcatcagtattcccctcgtggcttcaccacaaccgaatcaaccgaccttgccaatgctgtaatgatgagtttcctctaccctgtgattggaatgtttggagacctggtctacaccaggatattcgggaccttcacaaacacaatagctcagccttaccaaagccagaggatgatgcagcgtgagaagtctcttaatcgggtatcgatattcttcctttgttgcatcatcctttgcctccttctcttctag

SEQ ID NO: 906 - protein, 243 aa, Arabidopsis thaliana
MEGNFFIRSDAQRAHDNGFIAKQKPNLTTAPTAGQANESGCFDCNICLDTAHDPVVTLCGHLFCWPCIYKWLHVQLSSVSVDQHQNNCPVCKSNITITSLVPLYGRGMSSPSSTFGSKKQDALSTDIPRRPAPSALRNPITSASSLNPSLQHQTLSPSFHNHQYSPRGFTTTESTDLANAVMMSFLYPVIGMFGDLVYTRIFGTFTNTIAQPYQSQRMMQREKSLNRVSIFFLCCIILCLLLF

SEQ ID NO: 907 - DNA, 1026 bp, Arabidopsis thaliana
atggaaggaggaggaagaggaccaaatcaaacgattctcagtgaaatagaacatatgcctgaagctccacgtcaacgtatctctcatcaccgtcgagctcgctctgaaaccttcttctccggcgaatcaatcgacgatctcctcttattcgatccttccgatatcgatttctcttctctagacttcctcaacgctccaccaccaccacaacaatcacaacaacaaccgcaagcttctcccatgtccgttgattcggaagaaacctcatcgaacggtgttgttcctcctaattctcttcctccaaaacccgaagctagattcggtcgccatgttcgtagcttctcggttgattccgatttcttcgatgatttgggtgttactgaggagaagtttatagctacaagttcaggagagaagaagaaagggaatcatcatcatagcaggagtaattctatggatggagagatgagttcggcgtcgtttaatatcgaatcgattttagcttctgtgagtggtaaagatagtgggaagaagaatatgggtatgggtggtgatagacttgctgagcttgctttgcttgatcctaaaagagctaaaaggattttagcgaatagacaatctgcggcgaggtcgaaagagaggaagattaggtatactggtgagttagagaggaaggttcagacacttcagaatgaagctactacattgtctgctcaagtcactatgttacagagaggaacatcagagctgaacactgaaaataaacacctcaaaatgcggcttcaagctttagagcaacaagctgaacttagggatgctttgaatgaagcgctgcgggatgaactgaaccgacttaaggtggtagctggagaaattcctcaggggaatggaaattcttacaaccgtgctcaattctcatctcagcaatcggcaatgaatcagtttgggaacaaaacgaaccaacagatgagtacaaacgggcagccatcgctcccaagctacatggatttcaccaagagaggctga

SEQ ID NO: 908 - protein, 341 aa, Arabidopsis thaliana
MEGGGRGPNQTILSEIEHMPEAPRQRISHHRRARSETFFSGESIDDLLLFDPSDIDFSSLDFLNAPPPPQQSQQQPQASPMSVDSEETSSNGVVPPNSLPPKPEARFGRHVRSFSVDSDFFDDLGVTEEKFIATSSGEKKKGNHHHSRSNSMDGEMSSASFNIESILASVSGKDSGKKNMGMGGDRLAELALLDPKRAKRILANRQSAARSKERKIRYTGELERKVQTLQNEATTLSAQVTMLQRGTSELNTENKHLKMRLQALEQQAELRDALNEALRDELNRLKVVAGEIPQGNGNSYNRAQFSSQQSAMNQFGNKTNQQMSTNGQPSLPSYMDFTKRG

SEQ ID NO: 909 - DNA, 1927 bp, Arabidopsis thaliana
catctgatctgctctcgaagacgaaagcttcgagtactggttgaagctaaagctatgggacacgtgaatctacctgcatcaaagcgtggtaaccctcgtcaatggcgtctcctcgacatcgtaaccgctgctttcttcggtatcgtacttctcttcttcatccttttattcactcctcttggtgattccatggcggcttctggtcggcaaacgctgcttctctctacggcgtcagatccgaggcaacggcagcgattagtgactttggttgaagctggtcagcatttgcaaccgatcgagtattgtcctgcggaagctgttgctcatatgccttgtgaggatccgagaaggaatagtcagcttagtagagagatgaatttctatagggagagacattgtcctttgcctgaggagactccgctctgtttgattcctccgccttctggttataaaattcctgttccgtggcctgagagtcttcacaagatttggcatgcaaacatgccatataacaaaattgctgaccggaaaggtcatcaaggatggatgaaaagggaaggggaatactttactttcccaggcggtggcacgatgtttcctggcggagctggccaatacattgaaaagcttgcacagtatattccgcttaatggtggaactttgagaactgctcttgacatgggatgcggggtagctagttttggaggtactctactatctcaaggcattctagccctctcatttgctccaagagattcacataaatctcaaattcagttcgctttggaaagaggagtgcctgcatttgttgccatgcttggcactcgtagactcccctttcctgcatactcctttgacctgatgcactgttcccgatgtttgattccttttacggcttacaatgcaacttacttcatcgaagtagataggttactgcgccctggaggatatcttgtaatctctggcccacctgtacaatggcctaaacaagacaaagaatgggctgatcttcaggcggtggctagagctttgtgctatgagctaattgcggttgatggaaacactgtcatctggaagaagcctgttggagattcatgtctacctagccagaatgagtttgggcttgagttgtgtgatgagtctgttccgccaagtgatgcatggtattttaaattgaagaggtgtgttaccaggccatcatccgtcaaaggagaacacgctttgggaactatatccaagtggccggagaggcttactaaagttccttctagggccattgtcatgaaaaacggattggatgtgtttgaagcagatgcaaggcggtgggcaagacgcgttgcttattacagggattctcttaacttgaagctgaaatctccaactgtccgcaatgtcatggacatgaacgcattcttcggaggctttgcagcaacccttgcatctgatcctgtgtgggttatgaatgtcattccagctcggaagccattaactcttgacgtgatttatgacagaggtctcatcggtgtttaccatgattggtgtgaaccattttcaacatatccccgcacgtatgatttcatccatgtatcaggaattgaatcactgataaaacgacaagactcaagcaaatcgaggtgtagcctagtagatctaatggtagagatggacagaatattacgtccagaaggaaaggttgtgatccgagactctcctgaggtgctagataaagtcgcacgaatggctcatgctgtaagatggtcttcttccatacacgagaaagaacctgaatcccatggaagagagaagattcttatcgcaaccaaatctctctggaaattgccatcaaactcccactgaagacacaaaagaagaagaaaagaagaagctcttctcaatcttgtaggtactgtcacttgctctccagccc

SEQ ID NO: 910 - protein, 600 aa, Arabidopsis thaliana
MGHVNLPASKRGNPRQWRLLDIVTAAFFGIVLLFFILLFTPLGDSMAASGRQTLLLSTASDPRQRQRLVTLVEAGQHLQPIEYCPAEAVAHMPCEDPRRNSQLSREMNFYRERHCPLPEETPLCLIPPPSGYKIPVPWPESLHKIWHANMPYNKIADRKGHQGWMKREGEYFTFPGGGTMFPGGAGQYIEKLAQYIPLNGGTLRTALDMGCGVASFGGTLLSQGILALSFAPRDSHKSQIQFALERGVPAFVAMLGTRRLPFPAYSFDLMHCSRCLIPFTAYNATYFIEVDRLLRPGGYLVISGPPVQWPKQDKEWADLQAVARALCYELIAVDGNTVIWKKPVGDSCLPSQNEFGLELCDESVPPSDAWYFKLKRCVTRPSSVKGEHALGTISKWPERLTKVPSRAIVMKNGLDVFEADARRWARRVAYYRDSLNLKLKSPTVRNVMDMNAFFGGFAATLASDPVWVMNVIPARKPLTLDVIYDRGLIGVYHDWCEPFSTYPRTYDFIHVSGIESLIKRQDSSKSRCSLVDLMVEMDRILRPEGKVVIRDSPEVLDKVARMAHAVRWSSSIHEKEPESHGREKILIATKSLWKLPSNSH

SEQ ID NO: 911 - DNA, 1818 bp, Arabidopsis thaliana; identical to SEQ ID NO: 365

SEQ ID NO: 912 - protein, 574 aa, Arabidopsis thaliana; identical to SEQ ID NO: 366

SEQ ID NO: 913 - DNA, 1824 bp, Arabidopsis thaliana
ggggccgaccggccgcccgggcaggtctaggttcaaaaggactcacaagagagagatagtatgattgatagggaaagagagagagatgaaagaaagtaaaatatataatagattattaggacacgagtgtcatcttttgatttgtgtcttgtgtgctctctctttcttctcttcctcgaatgatcatctttatataaccctactctctttctcttttcccattctttcatatcattctccctttctctctcgggatctgatctctctttccagtaacctattcccgaggagcactgtcaaatcttgtccactctttgatcttatctcgatctctttctctttctagtcttgtgtagtcttcaaacttgtgatgttatctatatagtaatcacgagagagaatcatacaatagctgaaacataaagctttcttagaagctttaaaaaggtctcatctggattatcctgtttaatttctagagtttcttcaggcagattattaaccgatcaagaagacaaacatgaattcattttcccacgtccctccgggttttagatttcacccgacagatgaagaacttgtagactactacctgaggaaaaaagtcgcatcgaagagaatagaaattgatttcataaaggacattgatctttacaagattgagccatgggaccttcaagagttgtgcaaaattgggcatgaagagcagagtgattggtacttctttagccataaagacaagaagtatcccacagggactcgaaccaatagagcaacaaaagcagggttttggaaagccaccggaagagataaggctatctatttgaggcatagtctaattggcatgaggaaaacacttgtgttttacaagggaagagccccaaatggacaaaagtctgattggatcatgcacgaataccgcttagaaaccgatgaaaacggaactcctcaggaagaaggatgggttgtgtgtagggttttcaagaagagattggctgcagttagacgaatgggagattacgactcatccccttcacattggtacgatgatcaactttcttttatggcctccgagctcgagacaaacggtcaacgacggattctccccaatcatcatcagcagcagcagcacgagcaccaacaacatatgccatatggcctcaatgcatctgcttacgctctcaacaaccctaacttgcaatgcaagcaagagctagaactacactacaaccacctgcaatcaaatatcgcgcatgaggaacaattgaatcaaggaaatcagaacttcagctctctatacatgaacagcggcaacgagcaagtgatggaccaagtcacagactggagagttctcgataaatttgttgcttctcagctaagcaacgaggaggctgccacagcttctgcatctatacagaataatgccaaggacacaagcaatgctgagtaccaagttgatgaagaaaaagatccgaaaagggcttcagacatgggagaagaatatactgcttctacttcttcgagttgtcagattgatctatggaagtgagctgaaagagaagacatataaatgcatatatacatatatatatatacgtacacacgaacactaatcaagtgtagatgatgatgatggtacagatttatatttgctttgattgattcttactacattattgaacttatgtcatatgcatatatacattgcgtatctatgcatatttatacttgtactcaatatgattaaccatatataaactctaatctaaatgtaactccaatattttttaaatagacaattgtctcttcttattagaaaaaaaa

SEQ ID NO: 914 - protein, 342 aa, Arabidopsis thaliana
MNSFSHVPPGFRFHPTDEELVDYYLRKKVASKRIEIDFIKDIDLYKIEPWDLQELCKIGHEEQSDWYFFSHKDKKYPTGTRTNRATKAGFWKATGRDKAIYLRHSLIGMRKTLVFYKGRAPNGQKSDWIMHEYRLETDENGTPQEEGWVVCRVFKKRLAAVRRMGDYDSSPSHWYDDQLSFMASELETNGQRRILPNHHQQQQHEHQQHMPYGLNASAYALNNPNLQCKQELELHYNHLQSNIAHEEQLNQGNQNFSSLYMNSGNEQVMDQVTDWRVLDKFVASQLSNEEAATASASIQNNAKDTSNAEYQVDEEKDPKRASDMGEEYTASTSSSCQIDLWK

SEQ ID NO: 915 - DNA, 923 bp, Arabidopsis thaliana
gctacatatatgggttctattagaggaaacattgaagagcctatatctcagtcattaacgaggcagaactctctctatagcttaaagctccatgaggttcaaacccacttaggaagttctggaaaaccactaggaagcatgaaccttgatgagcttctcaagactgtcttgccaccagctgaggaagggcttgttcgtcagggaagcttgacgttacctcgagatctcagtaaaaagacagttgatgaggtctggagagatatccaacaggacaagaatggaaacggtactagtactactactactcataagcagcctacactcggtgaaataacacttgaggatttgttgttgagagctggtgtagtgactgagacagtagtccctcaagaaaatgttgttaacatagcttcaaatgggcaatgggttgagtatcatcatcagcctcaacaacaacaagggtttatgacatatccggtttgcgagatgcaagatatggtgatgatgggtggattatcggatacaccacaagcgcctgggaggaaaagagtagctggagagattgtggagaagactgttgagaggagacagaagaggatgatcaagaacagagaatctgcagcacgttcacgagctaggaaacaggcttatacacatgaattagagatcaaggtttcaaggttagaagaagaaaacgaaaaacttcggaggctaaaggaggtggagaagatcctaccaagtgaaccaccaccagatcctaagtggaagctccggcgaacaaactctgcttctctctgatcctaaagactcttctttctttcttcttctttgtgttggtttatatcagaccgctttgttctttgtatattgtgtagactttattgactttgaacagcatgtctttataaacatttcttgagtgt

SEQ ID NO: 916 - protein, 262 aa, Arabidopsis thaliana
MGSIRGNIEEPISQSLTRQNSLYSLKLHEVQTHLGSSGKPLGSMNLDELLKTVLPPAEEGLVRQGSLTLPRDLSKKTVDEVWRDIQQDKNGNGTSTTTTHKQPTLGEITLEDLLLRAGVVTETVVPQENVVNIASNGQWVEYHHQPQQQQGFMTYPVCEMQDMVMMGGLSDTPQAPGRKRVAGEIVEKTVERRQKRMIKNRESAARSRARKQAYTHELEIKVSRLEEENEKLRRLKEVEKILPSEPPPDPKWKLRRTNSASL

SEQ ID NO: 917 - DNA, 1177 bp, Arabidopsis thaliana
aaaaaccctaaccctaattctctcaagacaactcaaaggtctctccttttttaggtttattatcacttccgtataatcgccatgtcttctctaccatggaaaaaaccaaaatcgagtcgaatcttaagattcatttctgagtttcaacaatcaccgttcgttgaaactggctttccaacttctctgatcgatctcttcttcaagaatcgcgatcgtctaaaaaaatctccatctaaacgcttccaacgaatcgaacgccagattcgaaccgctccaaacgcttcttcgttgagtaatcaagatacgatttttgaaaagccctcgaggattaaaaccgttcgaagtaaggtcgagaaagttaattgcgttaaaggtaaatcagcggcgttgaagaagaacgcgattaaaaatagcgttttcggcggtagcggtgaggtcgttttgatggcgtttaaggttttgatagtagcgttgctcgccttgagcacgaagaagaagctcactttaggaatcactctctctgccttcgctcttctcttaacagagctcgtggcggcgcgtgttttcacgcgctctaataacaccgacaaagacaaaaacgcgattgcccgcgagaaaatcgaaacttttgatgaaactcgagttcccaaagcgattccatgtcctgaggaaacagagcatgtagtatctgaaacagaggtttcgaagttgaaaggtttaacgatacgtgatctgttgtcaaaggacgagaaatcaacaagtaaaagttggagactaaaatcgaagattgtgaagaagttgaggagttacaataagaaggataagaagacgatgaagatcaaagaagagtctttgattgaagtctcgagtttggttttagaagataaaccaaagaaaattgagtctgagagagacgaagaagaaacgttgaatcctccagtggttggatcaaacctgaatgggattgttctgatcgtgattgtgctaaccggtttgttatgtgggaaggtcttagctattgttctgacactatcatgtttggttcttagattaggagcagtcaaaaaagttaatctttgcatataattttttttgtattttttaacatgcttgcatgtgaaactgtaaatttttctcattcatatgaaggagattggattgaatgttgaatactaaa

SEQ ID NO: 918 - protein, 334 aa, Arabidopsis thaliana
MSSLPWKKPKSSRILRFISEFQQSPFVETGFPTSLIDLFFKNRDRLKKSPSKRFQRIERQIRTAPNASSLSNQDTIFEKPSRIKTVRSKVEKVNCVKGKSAALKKNAIKNSVFGGSGEVVLMAFKVLIVALLALSTKKKLTLGITLSAFALLLTELVAARVFTRSNNTDKDKNAIAREKIETFDETRVPKAIPCPEETEHVVSETEVSKLKGLTIRDLLSKDEKSTSKSWRLKSKIVKKLRSYNKKDKKTMKIKEESLIEVSSLVLEDKPKKIESERDEEETLNPPVVGSNLNGIVLIVIVLTGLLCGKVLAIVLTLSCLVLRLGAVKKVNLCI

SEQ ID NO: 919 - DNA, 871 bp, Arabidopsis thaliana
ctgctcatatcagccattgacacagttgctttgggtttccctcaaacggcgccgattgtctggattttgaccactgatggccttagatcaatcttttgaagatgctgctttacttggagaactctatggagaaggtgcattttgtttcaagagcaagaaacctgaacccattacagtctcggttccttctgatgatactgatgattcgaattttgactgcaatatttgcttagactcggtgcaagaacctgttgtgactctctgtggtcacctcttttgctggccttgtattcacaaatggcttgatgtacagagcttctcaacaagtgatgaataccaaagacatagacagtgtcctgtttgtaaatctaaagtttctcattctactttggttcctttgtatggtagaggccgttgtactactcaggaggaaggtaaaaacagtgtgcctaaaagacccgtaggaccggtttatcggcttgaaatgccgaattcaccttatgcaagtactgatctgcggttatcacaacgggttcatttcaatagcccacaggaaggttactaccctgtctcaggggtgatgagctcgaacagtttatcatactctgctgttttggatccggtgatggtgatggttggagaaatggtagctacgaggttgtttggaacacgagtgatggatagatttgcgtatccggacacttacaatctcgcagggactagcgggccgaggatgagaaggcggataatgcaggcagataaatcgctgggaagaatcttcttcttctttatgtgttgtgttgttctgtgtcttctcttgttttaggttttcatagctagcttggttctgctactgttcagtttcttcagg

SEQ ID NO: 920 - protein, 249 aa, Arabidopsis thaliana
MALDQSFEDAALLGELYGEGAFCFKSKKPEPITVSVPSDDTDDSNFDCNICLDSVQEPVVTLCGHLFCWPCIHKWLDVQSFSTSDEYQRHRQCPVCKSKVSHSTLVPLYGRGRCTTQEEGKNSVPKRPVGPVYRLEMPNSPYASTDLRLSQRVHFNSPQEGYYPVSGVMSSNSLSYSAVLDPVMVMVGEMVATRLFGTRVMDRFAYPDTYNLAGTSGPRMRRRIMQADKSLGRIFFFFMCCVVLCLLLF

SEQ ID NO: 921 - DNA, 1674 bp, Arabidopsis thaliana
agaagaagaagaagaagagtacctcatacgtaaaccattgatgggctcttttgatcgccaaagagctgttccgaaattcaaaacagcaacaccgtcaccgctccctctttctccttcgccttacttcactatgcctcctggccttactcccgccgactttctcgactctcctcttctcttcacttcctccaacattttgccgtctcctacgacaggcacatttccagcgcaatctctgaactataacaataacggtttgctcattgacaaaaatgaaatcaaatatgaagacacaactcctcccttgttcctaccatctatggtaactcagcctttacctcaactggatttattcaaatccgaaatcatgtcgagtaacaaaacctctgatgacggctacaattggcgcaaatacgggcagaagcaagtcaaaggaagcgaaaacccgaggagttacttcaaatgcacgtatccaaattgtctcacaaagaagaaagtagagacgtctcttgtgaagggtcagatgattgagattgtctataaaggaagccacaatcatcccaagccccaatccacgaagcgatcatcttccaccgctatagcagcacatcagaacagcagtaatggagacggtaaagacattggtgaagatgaaacagaggccaagagatggaaaagagaagagaatgtgaaggagccaagagtggtggttcagacaacaagtgatatagacattcttgacgatggctacagatggagaaagtatggtcagaaagtcgtcaagggtaatccaaatccaaggagctattacaagtgcacatttacaggatgttttgtaaggaaacacgttgaaagagcatttcaagatcccaagtcagtgatcacaacttacgaaggaaaacacaaacaccaaatcccgaccccaagaagaggtccagttttaagatctgctgcaatggcttctcctcttctcccaacttcgactactcctgatcaacttcccggcggcgatccacagttgctgagctctctacgcgtcctcttgtcccgcgttctagccaccgtccgtcacgcttctgcagatgccagaccctgggcagagctcgttgaccggtcagcgttttcccggccaccatcgctctcggaggcaacgtcacgagtaaggaagaacttttcctatttccgagccaattacataaccttagtggcaatcttactcgccgcgtctctgctcacgcaccctttcgctctcttcctcctcgcatcgctggccgcttcttggcttttcctctactttttccgtccggcggatcagccgttggtcattggaggacgcacgttctccgatcttgagacgctagggatactctgcctgtccactgtggtggtgatgttcatgaccagcgttggatcgctcttgatgtccactctagcagttgggatcatgggcgtggccatccacggagcgtttcgtgctcccgaagacctgtttcttgaagaacaagaagccattggatctggacttttcgcattcttcaacaacaatgcctctaatgcagctgccgctgccatagccacctcagcaatgtcacgcgttcgagtctgagattgttgaagagactacattcctacaccgcatttccaaagtgtgatatttattcatattgaattgtt

SEQ ID NO: 922 - protein, 521 aa, Arabidopsis thaliana
MGSFDRQRAVPKFKTATPSPLPLSPSPYFTMPPGLTPADFLDSPLLFTSSNILPSPTTGTFPAQSLNYNNNGLLIDKNEIKYEDTTPPLFLPSMVTQPLPQLDLFKSEIMSSNKTSDDGYNWRKYGQKQVKGSENPRSYFKCTYPNCLTKKKVETSLVKGQMIEIVYKGSHNHPKPQSTKRSSSTAIAAHQNSSNGDGKDIGEDETEAKRWKREENVKEPRVVVQTTSDIDILDDGYRWRKYGQKVVKGNPNPRSYYKCTFTGCFVRKHVERAFQDPKSVITTYEGKHKHQIPTPRRGPVLRSAAMASPLLPTSTTPDQLPGGDPQLLSSLRVLLSRVLATVRHASADARPWAELVDRSAFSRPPSLSEATSRVRKNFSYFRANYITLVAILLAASLLTHPFALFLLASLAASWLFLYFFRPADQPLVIGGRTFSDLETLGILCLSTVVVMFMTSVGSLLMSTLAVGIMGVAIHGAFRAPEDLFLEEQEAIGSGLFAFFNNNASNAAAAAIATSAMSRVRV

SEQ ID NO: 923 - DNA, 1888 bp, Arabidopsis thaliana
cccaatttgagattgttcgatttcgatctacgagattcttacaagaacataagcagcttcggttttttgggattatcttatttggtcggatgatgatcttctcgatgtctgtgctaggctttgggaattagatatatttggggttaagctcgagtctctccggttttgagtttacttgagtttgttagtatttatggctgaggtgggaaaagttctggctagtgatatggagttagaccattcaaatgagactaaagcagtggatgatgttgttgccactactgataaagcggaggtcataccagtggctgtaactagaactgaaaccgttgttgaaagtttggaatctactgactgtaaggagcttgaaaaacttgttccacatacggtagcttcgcagtcggaagtagatgttgcttccccggtatccgagaaagcaccgaaggtttctgaaagtagcggtgcattatctttgcagtctggttcggaagggaatagtccttttattcgtgagaaggttatggaagacggatacaactggcggaaatatggacagaaacttgtgaaaggaaatgagtttgtaaggagctattacaggtgcactcaccctaactgcaaagcgaaaaaacagttggaacggtctgcgggtggacaagtcgtggataccgtttactttggggaacatgatcacccaaagcctcttgctggtgctgttcctatcaatcaggataagcgaagtgatgtcttcacagctgttagtaaagagaaaacatctggatccagtgttcagacacttcgtcaaaccgaaccaccaaagatccatggaggattacatgtttcagttattccaccagctgatgatgtgaaaactgatatttcacaatcaagtaggataacgggggacaacactcacaaggattataatagtcctaccgcaaagcgaaggaagaaaggagggaacattgagctgagtccagtggagaggtcaaccaatgattcacgcattgtggttcacactcagactctgtttgatattgtgaatgatgggtaccgatggcgtaaatatggtcagaaatcagtaaaaggcagcccatatccaaggagctactatagatgttcaagccctggatgccccgtcaagaaacacgtagagaggtcatctcatgacacaaagttgcttataacaacttacgagggaaaacacgaccacgatatgcctccaggaagagttgttactcataataacatgctggactcggaagttgatgataaagaaggagatgccaacaagactccacagagctcaactcttcaatccattacaaaagaccagcatgtcgaagatcacttaagaaagaaaacgaagactaatggctttgagaaaagtcttgatcaaggtccagttttggatgagaagctgaaggaggaaataaaagagagatcagatgcaaacaaagatcacgcagccaatcacgccaagccggaagcaaagtcagatgataaaaccactgtttgtcaagagaaggcagtaggaaccctggagagcgaggaacaaaaacccaagacagagcctgcccaaagctaagcattcagtgttgtaccgagtggtaatttatatggctgttttaacatagattagtacaggcgatatggttatagactgtacagttgttgttcaggcgggaccagatttagattagtgtttaatggaatagtatgctttaatacctttatgtaaccacttccatttggttcaaataagagttacaggaagagaaggtaacacaacaagagcccttctttgttgatggagcctgtgtaatagttgtagcatggggatgtatatgatttgattcaaccttattaatggttatgagacaaaactatc

SEQ ID NO: 924 - protein, 463 aa, Arabidopsis thaliana
MAEVGKVLASDMELDHSNETKAVDDVVATTDKAEVIPVAVTRTETVVESLESTDCKELEKLVPHTVASQSEVDVASPVSEKAPKVSESSGALSLQSGSEGNSPFIREKVMEDGYNWRKYGQKLVKGNEFVRSYYRCTHPNCKAKKQLERSAGGQVVDTVYFGEHDHPKPLAGAVPINQDKRSDVFTAVSKEKTSGSSVQTLRQTEPPKIHGGLHVSVIPPADDVKTDISQSSRITGDNTHKDYNSPTAKRRKKGGNIELSPVERSTNDSRIVVHTQTLFDIVNDGYRWRKYGQKSVKGSPYPRSYYRCSSPGCPVKKHVERSSHDTKLLITTYEGKHDHDMPPGRVVTHNNMLDSEVDDKEGDANKTPQSSTLQSITKDQHVEDHLRKKTKTNGFEKSLDQGPVLDEKLKEEIKERSDANKDHAANHAKPEAKSDDKTTVCQEKAVGTLESEEQKPKTEPAQS

SEQ ID NO: 925 - DNA, 705 bp, Arabidopsis thaliana
atggataccaacaaccagcaaccacctccctccgccgccggaatccctcctccaccacctggaaccaccatctccgccgcaggaggaggagcttcttaccaccaccttctccaacaacaacaacaacagctccaactattctggacctaccaacgccaagagatcgaacaagttaacgatttcaaaaaccatcagcttccactagctaggataaaaaagatcatgaaagccgatgaagatgttcgtatgatctccgcagaagcaccgattctcttcgcgaaagcttgtgagcttttcattctcgagctcacgatcagatcttggcttcacgctgaggagaataaacgtcgtacgcttcagaaaaacgatatcgctgctgcgattactaggactgatatcttcgatttccttgttgatattgttcctagagatgagattaaggacgaagccgcagtcctcggtggtggaatggtggtggctcctaccgcgagcggcgtgccttactattatccgccgatgggacaaccagctggtcctggagggatgatgattgggagaccagctatggatccgaatggtgtttatgtccagcctccgtctcaggcgtggcagagtgtttggcagacttcgacggggacgggagatgatgtctcttatggtagtggtggaagttccggtcaagggaatctcgacggccaagggtaa

SEQ ID NO: 926 - protein, 234 aa, Arabidopsis thaliana
MDTNNQQPPPSAAGIPPPPPGTTISAAGGGASYHHLLQQQQQQLQLFWTYQRQEIEQVNDFKNHQLPLARIKKIMKADEDVRMISAEAPILFAKACELFILELTIRSWLHAEENKRRTLQKNDIAAAITRTDIFDFLVDIVPRDEIKDEAAVLGGGMVVAPTASGVPYYYPPMGQPAGPGGMMIGRPAMDPNGVYVQPPSQAWQSVWQTSTGTGDDVSYGSGGSSGQGNLDGQG

SEQ ID NO: 927 - DNA, 1757 bp, Arabidopsis thaliana
atctgaagtgaaccaagctcaggttttgtcttctctttgatcattcctttctcagcaatataaattagagttatatcctttataaaggattttgctttttcaccaacaaaccctaaattcggtgtctcagcaagaatcacgtgattctcgttcctcttcctcacgaaacccatcatcttctatctcatttgagaaatgggtcaaaagttttgggagaatcaagaagatcgagcgatggttgaatccaccataggctctgaagcttgcgactttttcatctcaacagcttcagcttccaacactgccttgtccaagcttgtctcaccaccaagtgattccaatctccaacaagggttacgtcacgttgttgaaggatctgattgggattatgctcttttctggctagcgtccaacgttaatagctctgatggttgtgtcttgatctggggagatggtcattgccgtgtcaaaaagggtgcttcaggtgaggattactctcagcaagatgagatcaaaagacgtgtgcttcgcaagcttcacttgtcgttcgttggttcagatgaagatcatcgtttggtgaaatcaggagctcttactgatctcgacatgttttatctggcttctttgtacttttcctttaggtgtgataccaataagtacggtcctgctggaacctatgtgtctgggaagcctctttgggctgcagatttgcctagctgcttgagttattatagggttaggtctttcttagctaggtcagctggttttcagactgtgttgtctgtaccagtgaattctggagttgtggagcttggttctttaagacatattccagaagataagagtgtgattgagatggtgaaatcagtgtttggtgggtctgactttgttcaggctaaagaagctcctaaaatctttggtcgacagctgagtcttggtggagcaaaacctcggtctatgagtattaatttctccccgaagaccgaggatgacacgggtttctcattggaatcgtatgaggtgcaagcgatcggaggctctaatcaagtgtatggttatgagcaagggaaagatgagacattgtatctaactgacgagcaaaagccgaggaagagagggagaaaaccagcaaatggaagagaagaggctctaaaccatgtggaagcggaacggcagaggagggagaagctgaaccagagattctacgctttgagagcggtggtgcctaacatctccaagatggacaaggcttcgctccttgcagacgcaatcacttacatcacggatatgcagaagaaaatcagggtgtatgaaacagagaagcagataatgaagaggagggagagtaatcagataactccagcagaggttgattatcaacagaggcatgatgatgcagttgtaaggctaagctgtccgttggaaactcatccagtttcaaaggtgatacaaacgttgagggagaatgaagttatgcctcatgattccaacgtggccatcacagaggagggtgtggttcacacattcactctccggcctcagggtggctgcaccgctgagcagttgaaggacaagctccttgcctctctatcacagtaactatcacagcagtaactgctatgtaataagtgtaaccgtgttggaggttgtatcaatgtactattgcaagccaaccaaaaaaaactccagcttagtaggatcgtgtaattttccttatatgtaatgttgagatttgtcttttacatataaagatttga

SEQ ID NO: 928 - protein, 467 aa, Arabidopsis thaliana
MGQKFWENQEDRAMVESTIGSEACDFFISTASASNTALSKLVSPPSDSNLQQGLRHVVEGSDWDYALFWLASNVNSSDGCVLIWGDGHCRVKKGASGEDYSQQDEIKRRVLRKLHLSFVGSDEDHRLVKSGALTDLDMFYLASLYFSFRCDTNKYGPAGTYVSGKPLWAADLPSCLSYYRVRSFLARSAGFQTVLSVPVNSGVVELGSLRHIPEDKSVIEMVKSVFGGSDFVQAKEAPKIFGRQLSLGGAKPRSMSINFSPKTEDDTGFSLESYEVQAIGGSNQVYGYEQGKDETLYLTDEQKPRKRGRKPANGREEALNHVEAERQRREKLNQRFYALRAVVPNISKMDKASLLADAITYITDMQKKIRVYETEKQIMKRRESNQITPAEVDYQQRHDDAVVRLSCPLETHPVSKVIQTLRENEVMPHDSNVAITEEGVVHTFTLRPQGGCTAEQLKDKLLASLSQ

SEQ ID NO: 929 - DNA, 896 bp, Arabidopsis thaliana
gtccctcctcttagcttcaaccgccggaaaaactaaacaaccttcttggaaaaaaagagaaactaaaaatgaactatccttcaaaccctaaccctagctccacagatttcactgaatttttcaagttcgatgattttgacgatacttttgagaagatcatggaagaaatcggccgtgaggaccactcgtcgtcaccgactttgagttggagttcatcggaaaagttagtggctgcagaaatcacaagcccgcttcaaacaagcctagctacctcacctatgagctttgaaataggtgacaaagatgaaatcaaaaagaggaagagacacaaagaagatccgattattcacgtcttcaaaacgaaatcatcaattgatgaaaaggttgctttagatgatgggtataaatggaggaaatacggaaagaagccgataacgggtagtccatttccaaggcattatcacaagtgttcgagcccagattgcaacgtgaagaagaagatcgaaagagatacgaacaatccagattacatattgacaacatacgaaggtagacataaccacccaagcccttctgtagtttattgtgattcagacgactttgatcttaactctctcaacaattggtcctttcagacggcaaatacgtatagtttctctcattctgctccatattgatcgatcgtagttacaagtttgtgtatatagatgtatatatatatatcaccaattcaccatcgtaatcacgtctcacatgtaactacgtacatatatcttgttcggggttcgttttgtaatgtattgaattggtggaggtagaatggaagtcatcttgtatagttgtacttgtatgtaaggtttgatagtcattttttataaagtaactaatttgtacaa

SEQ ID NO: 930 - protein, 202 aa, Arabidopsis thaliana
MNYPSNPNPSSTDFTEFFKFDDFDDTFEKIMEEIGREDHSSSPTLSWSSSEKLVAAEITSPLQTSLATSPMSFEIGDKDEIKKRKRHKEDPIIHVFKTKSSIDEKVALDDGYKWRKYGKKPITGSPFPRHYHKCSSPDCNVKKKIERDTNNPDYILTTYEGRHNHPSPSVVYCDSDDFDLNSLNNWSFQTANTYSFSHSAPY

SEQ ID NO: 931 - DNA, 929 bp, Arabidopsis thaliana
gtctctaatataagcttgaacgttgctatatataaatgtaaaggcgaacgcataagaaaagaaaaatggagaatgaagcttttgtagatggtgaattggagtctcttttggggatgttcaactttgatcaatgttcatctaacgaatcgagcttttgcaatgctccaaatgagactgatgttttctcttctgatgatttcttcccatttggtacaattctgcaaagtaactatgcggccgttcttgatggttccaaccaccaaacgaaccgaaatgtcgactcaagacaagatctgttgaaaccaaggaagaagcaaaagttaagctcggaaagcaatttggttaccgagcctaagactgcttggagagatggtcaaagcctaagcagttataatagttcagatgatgaaaaggctttaggtttagtgtctaatacatcaaaaagcctaaaacgcaaagcgaaagccaacagagggatagcttccgatcctcagagcctatacgctaggaaacgaagagaaaggataaacgataggctaaagacattgcagagcctagttcctaatgggacaaaggtcgatataagcacaatgctggaagatgctgtccattacgtgaagttcctgcagcttcaaatcaagctcttgagttcagaagatctatggatgtatgcacctcttgctcacaatggtctgaatatgggactacatcacaatcttttgtctcggcttatttaagacaaaatcattggaataacataacttacagtacttgttttttttctcgttctatattcatgattatggttattttttgtttgagttgttcaatttttctgtctattgcgttctatgaacttgacactctttttgtaattattatatgctaaagacaatttggactaacagcattttaataaaaaaaaaaaa

SEQ ID NO: 932 - protein, 223 aa, Arabidopsis thaliana
MENEAFVDGELESLLGMFNFDQCSSNESSFCNAPNETDVFSSDDFFPFGTILQSNYAAVLDGSNHQTNRNVDSRQDLLKPRKKQKLSSESNLVTEPKTAWRDGQSLSSYNSSDDEKALGLVSNTSKSLKRKAKANRGIASDPQSLYARKRRERINDRLKTLQSLVPNGTKVDISTMLEDAVHYVKFLQLQIKLLSSEDLWMYAPLAHNGLNMGLHHNLLSRLI

SEQ ID NO: 933 - DNA, 799 bp, Arabidopsis thaliana
cgccgtcactctcctcccggtgccgcacattagcaacactactcccgacgaatggagacgacgacgccgcagtcaaaatcaagtgtgtcccaccgaccgccgttgggaagagaagactggtggagtgaggaagcgacggcgacgctggtagaagcctggggcaatcgttacgtcaagctgaaccacggaaatctccggcagaatgactggaaagacgtcgccgacgccgttaactctagacacggtgataacagccgtaagaagaccgacttacagtgtaagaaccgggtcgatactttgaagaagaagtacaaaacagagaaagctaaactctcgccgtcgacttggcgtttctataaccgcctcgatgttctaatcggtcccgttgtgaagaaatcggctggcggagttgtcaaatcagcgccttttaagaatcatctgaatccaactggatcgaactctactggaagctctcttgaagatgatgatgaggatgatgatgaggttggtgattgggaattcgttgctaggaagcatcctcgtgtggaagaggtagatctgagtgaaggatcaacgtgtagggaactagctacggcgattctcaagtttggagaagtttacgagagaattgaagggaagaagcaacagatgatgattgagttggagaagcagagaatggaagtgacaaaggaggtagagttaaaacgaatgaacatgttgatggagatgcagttagagattgagaaatcaaagcaccggaaacgcgcaagtgcttcaggtaagaagaactcacattagg

SEQ ID NO: 934 - protein, 248 aa, Arabidopsis thaliana
METTTPQSKSSVSHRPPLGREDWWSEEATATLVEAWGNRYVKLNHGNLRQNDWKDVADAVNSRHGDNSRKKTDLQCKNRVDTLKKKYKTEKAKLSPSTWRFYNRLDVLIGPVVKKSAGGVVKSAPFKNHLNPTGSNSTGSSLEDDDEDDDEVGDWEFVARKHPRVEEVDLSEGSTCRELATAILKFGEVYERIEGKKQQMMIELEKQRMEVTKEVELKRMNMLMEMQLEIEKSKHRKRASASGKKNSH

SEQ ID NO: 935 - DNA, 1127 bp, Arabidopsis thaliana
cgtcgaccattcttgcgattgatctttctctagataatttttttgatcgatttagtttcattatggaggacgacgacgcagcttatgatctaatcaaacacgaactgttatactcagaagacgaagtaataatctcacgttatctgaagggtatggtcgttaacggagattcttggccagatcacttcatcgaagacgcaaacgtgttcaccaagaatccagataaggtgttcaattctgagagacctagattcgtgatcgttaaaccacgaacagaggcttgtggtaaaaccgatggatgtgattcgggttgctggaggatcattggtcgtgataaactgataaagtcggaggagactgggaagattctagggttcaagaagatactcaagttttgcctaaagaggaaacctatagactacaagagaagttgggtaatggaagagtataggcttaccaataacttgaactggaagcaagatcatgtgatttgcaaaattcggtttatgtttgaagctgaaattagtttcttgctaagcaagcatttctacactacatcagaatcggttcttgaaaatgagctgttgccatcttatggatattatttatccaatacacaagaggaggatgaattttatctggacgcgataatgacttcggaaggaaacgagtggcctagctacgttaccaacaacgtgtactgtctgcatccattggagcttgtggatcttcaagatcggatgtttaatgattacggaacctgcatcttcgctaacaagacttgtggtgaaactgataaatgcgatggtggttactggaagatcctgcacggtgataagctgatcaagtcaaatttcggaaaggtcattggtttcaagaaggtatttgagttctatgaaacggtgagacaaatatatctttgtgatggagaagaagtgacggtaacttggactatacaagagtataggcttagcaaaaacgtgaagcagaataaagtgttgtgcgttatcaagttgacttatgatagataggatactttactttggtttttgtgatcatcttagtatcttacgaatattctagatacacacatctataggcgaccgctctagacaggcctcgtaccg

SEQ ID NO: 936 - protein, 322 aa, Arabidopsis thaliana
MEDDDAAYDLIKHELLYSEDEVIISRYLKGMVVNGDSWPDHFIEDANVFTKNPDKVFNSERPRFVIVKPRTEACGKTDGCDSGCWRIIGRDKLIKSEETGKILGFKKILKFCLKRKPIDYKRSWVMEEYRLTNNLNWKQDHVICKIRFMFEAEISFLLSKHFYTTSESVLENELLPSYGYYLSNTQEEDEFYLDAIMTSEGNEWPSYVTNNVYCLHPLELVDLQDRMFNDYGTCIFANKTCGETDKCDGGYWKILHGDKLIKSNFGKVIGFKKVFEFYETVRQIYLCDGEEVTVTWTIQEYRLSKNVKQNKVLCVIKLTYDR

SEQ ID NO: 937 - DNA, 1374 bp, Arabidopsis thaliana
  misc_feature (1144)..(1360): n=a,t,c or g
tgaaacctagatttctgcaactgaattcctaattcgaaaaagaatggagggttcgtcgtcgacgatagcaaggaagacatgggaactagagaacagcattctaacagtagactcacctgattcaacctccgacaacatcttctactacgacgatacttcacagactaggttccagcaagagaaaccgtgggagaatgatcctcactactttaaacgagtcaagatctcagcgctcgctcttcttaagatggtggttcacgctcgctctggtggtacaattgaaataatgggtcttatgcaaggtaagaccgatggtgatactatcattgttatggatgcttttgctttaccagtggaaggtactgagacaagggttaatgctcaggatgatgcttatgagtacatggttgagtattcacagaccaacaagctcgcggggcggctggagaatgttgttggatggtatcactctcaccctggatatggatgctggctctccggtattgatgtttctacgcagacgcttaaccaacagcatcaggagccatttttagctgttgttattgatcccacaaggactgtttcagctggtaaggttgagattggtgctttcagaacatactctaaaggatataagcctccagatgaacctgtttctgagtatcaaactattcctttaaataagattgaggactttggtgttcactgcaaacagtactattcattagatgtcacttatttcaagtcatctcttgattctcaccttctggatctactatggaacaagtactgggtgaacactctttcttcttctccactgctgggtaatggagactatgttgctggacaaatatcagacttagctgagaagcttgagcaagccgagagtcatctggttcagtctcgctttggaggagttgtgccatcatcccttcataagaaaaaagaagatgagtctcaactaactaagataactcgggatagcgcaaagataactgtggaacaggtccatggactaatgtcgcaggtcataaaagatgaattattcaactcaatgcgtcagtccaacaacaaatctcccactgactcgtcggatccagaccctatgattacatattgaagttgctcttcttttggtttctanttttggattgacccatcatttgttgtcctttcatttattttctgttgtgtaaagaattataatgncgncgcgaattcgcggccgctaaaaaaanacaggaaattgaaaanaattcnnccattccaacatctttatttaatattatctcctcnattatataatattcaaacatccctantancttcatttgaccgtccccctccctcccgtgttgcnttggtgctggcccc

SEQ ID NO: 938 - protein, 358 aa, Arabidopsis thaliana
MEGSSSTIARKTWELENSILTVDSPDSTSDNIFYYDDTSQTRFQQEKPWENDPHYFKRVKISALALLKMVVHARSGGTIEIMGLMQGKTDGDTIIVMDAFALPVEGTETRVNAQDDAYEYMVEYSQTNKLAGRLENVVGWYHSHPGYGCWLSGIDVSTQTLNQQHQEPFLAVVIDPTRTVSAGKVEIGAFRTYSKGYKPPDEPVSEYQTIPLNKIEDFGVHCKQYYSLDVTYFKSSLDSHLLDLLWNKYWVNTLSSSPLLGNGDYVAGQISDLAEKLEQAESHLVQSRFGGVVPSSLHKKKEDESQLTKITRDSAKITVEQVHGLMSQVIKDELFNSMRQSNNKSPTDSSDPDPMITY

SEQ ID NO: 939 - DNA, 1035 bp, Arabidopsis thaliana
gaccatggcggaggaatttggaagcatagatttactcggagatgaagatttcttcttcgatttcgatccttcaatcgtaattgattctcttccggcggaggattttcttcagtcttcaccggattcatggatcggagaaatcgagaatcaattgatgaacgatgagaatcatcaagaggagagttttgtggaattggatcagcaatcggtttcagatttcatagcggatctactcgttgattatccaactagcgattctggctccgttgatttggcggctgataaagttctaaccgtcgattctcccgccgccgctgatgattccgggaaggagaattcggatttggttgttgagaagaagtctaatgattctggtagcgagattcatgatgatgatgacgaagaaggagacgatgatgctgtggctaaaaaacgaagaaggagagtaagaaatagagatgcggcggttagatcgagagagaggaagaaggaatatgtacaagatttagagaagaagagtaagtatctcgaaagagaatgcttgagactaggacgtatgcttgagtgcttcgttgctgaaaaccagtctctacgttactgtttgcaaaagggtaatggcaataatactaccatgatgtcgaagcaggagtctgctgtgctcttgttggaatccctgctgttgggttccctgctttggcttctgggagtaaacttcatttgcctattcccttatatgtcccacacaaagtgttgcctcctacgtccagaaccagaaaagctggttctaaacgggctcgggagtagtagcaaaccgtcttataccggcgttagtcggagatgtaagggttcgaggcctaggatgaaataccaaatcttaacccttgcggcgtgacaacgccttttttaactgcttcttttgcgcattttgagttgtagatgagtgtcttttagttttctctctcttgttttgtatttcgctgttgaaagttttctgtctaatatcgataagttaacagtgaaaaaaaaaaaaaaaaa

SEQ ID NO: 940 - protein, 295 aa, Arabidopsis thaliana
MAEEFGSIDLLGDEDFFFDFDPSIVIDSLPAEDFLQSSPDSWIGEIENQLMNDENHQEESFVELDQQSVSDFIADLLVDYPTSDSGSVDLAADKVLTVDSPAAADDSGKENSDLVVEKKSNDSGSEIHDDDDEEGDDDAVAKKRRRRVRNRDAAVRSRERKKEYVQDLEKKSKYLERECLRLGRMLECFVAENQSLRYCLQKGNGNNTTMMSKQESAVLLLESLLLGSLLWLLGVNFICLFPYMSHTKCCLLRPEPEKLVLNGLGSSSKPSYTGVSRRCKGSRPRMKYQILTLAA

SEQ ID NO: 941 - DNA, 1022 bp, Arabidopsis thaliana
cattaaattggctcctgtgaacctaaatttatggactatgatcccaacaccaatccgttcgaccttcatttctccggtaaacttccgaaaagagaagtctcggcttcagcttctaaagttgtagagaagaaatggttagtgaaagatgagaagagaaatatgctacaagatgaaataaaccgggttaattcggagaacaagaagctaaccgaaatgttagcaagagtctgtgagaagtactatgctcttaataatcttatggaggagttgcagagtcgaaagagtcctgaaagtgttaactttcagaacaaacagctaacggggaaacgaaaacaagaacttgatgagtttgttagctccccaattggactcagtctcggaccaatcgagaacatcaccaacgataaagcgacggtttcaaccgcttactttgctgctgagaagtctgacacaagcttgactgtgaaagatggatatcaatggaggaaatacgggcaaaagattacgagagataatccatctcctagagcttacttcagatgctcgttttcaccgtcttgtctagtcaagaagaaggtgcaacgaagtgcagaagatccatctttcttggtagccacttacgaagggacacataaccacaccggaccacatgcaagtgtgtccaggacagtgaaacttgatctagttcaaggtgggcttgaaccagttgaggaaaagaaagagagagggacgattcaagaggttttggtgcaacaaatggcttcttcgttgaccaaagatcctaagttcactgcagctcttgcgactgctatttccgggagattgatagagcattcaagaacatgaaagttctctagaacatgtatatttctgttttgttctattttgttgctcattcctagtaaaaaggtaaagatttgtttgatcttgattaggaggcatagatgtcaattttaatgtgtgtgtatataattacatcaaatctaagtatccaaaaagggtcacccccattttatcttatg

SEQ ID NO: 942 - protein, 271 aa, Arabidopsis thaliana
MDYDPNTNPFDLHFSGKLPKREVSASASKVVEKKWLVKDEKRNMLQDEINRVNSENKKLTEMLARVCEKYYALNNLMEELQSRKSPESVNFQNKQLTGKRKQELDEFVSSPIGLSLGPIENITNDKATVSTAYFAAEKSDTSLTVKDGYQWRKYGQKITRDNPSPRAYFRCSFSPSCLVKKKVQRSAEDPSFLVATYEGTHNHTGPHASVSRTVKLDLVQGGLEPVEEKKERGTIQEVLVQQMASSLTKDPKFTAALATAISGRLIEHSRT

SEQ ID NO: 943 - DNA, 1913 bp, Arabidopsis thaliana
ggcaagaagaaccttagcctctctttcttctttctctctctctctctctgtggtactgttctgtttcaactttactccctcagtttcagaacaattccctatctagaagagagataaaaccgagaaggttttggagatagaatcttttgttcttcttttgtccctccttgctcgatttttgttacgtgtgaagcaataaaaaaaaactgatatagctaaatcttccatccattcagaggcttctaaatctgatctgacatggaacaagtgtttgctgattggaattttgaagataattttcacatgtccactaataaaagatcaatcagaccagaagatgaattagtggagctattgtggagagatggtcaagtggttttacaaagccaagctcgtagagaaccgtcagtccaagtccaaacccacaaacaagaaaccctaagaaaacccaacaatatttttcttgacaaccaagaaacagtacaaaagcctaactacgctgctctagatgatcaagaaaccgtctcctggatacaataccctccggatgacgtcatcgaccctttcgaatccgagttctcctctcatttcttctcttcgatcgatcacctcggaggtcctgagaagccacgaacgatcgaagagacagttaagcatgaggctcaagccatggctcctcctaagtttagatcctcggttataacagtcggaccgagtcattgcggcagcaaccagtcaacaaatattcatcaggccactacacttccggtttctatgagtgatagaagcaagaacgtcgaagaaagacttgacacttcgtcaggtggctcctccggttgcagctatggaaggaacaacaaagaaaccgttagtggaacaagtgtaaccattgaccgtaaaagaaaacatgttatggatgctgatcaagaatctgtgtctcaatcagatataggtttgacctcaaccgatgatcaaaccatgggtaacaaatcgagccaacggtcaggatctactcgaagaagccgtgcagctgaagttcataatctctcagaaaggaggaggagagatcggatcaatgaaagaatgaaagctcttcaagaactcatacctcactgcagcagaacagataaagcttcgatattggatgaagcaattgattacttaaaatcacttcaaatgcaactccaagtgatgtggatgggaagtggaatggcggcggcggcagcagcagcagcaagtccgatgatgtttcccggggtacaatcatctccatacattaatcagatggctatgcaaagtcagatgcaattgtctcaattcccggttatgaaccggtccgctccgcagaaccatcccggtttagtatgtcaaaacccggtacagttgcagctccaagcacagaaccaaatcttatcggagcagctcgctaggtacatgggcgggattccccagatgccgccggcgggaaatcagatgcagaccgtgcaacaacaaccagcggacatgttgggatttggatctccggcgggaccgcaaagtcaactgtcggcaccggcgaccaccgacagtcttcatatgggtaaaataggctgacttggcatatagttttcctccgaaattattcttcttacagttggtgattgttatttatttttggtcgcctaagcaagcataaaagctaagtcaaatgtattatagagatctaataagttagtctcatacttataacttatttttaaacagttgaattatagtatcaatcaagtgttgggaacctaaagatcatacatgtgtcaatacttttatatttgttctcaaggttcatcagaaaaacaaaataaaaaggatagactaggcctgcatttgacattatcatgggcttttttgggtctatgaatatgaacattaacccc

SEQ ID NO: 944 - protein, 444 aa, Arabidopsis thaliana
MEQVFADWNFEDNFHMSTNKRSIRPEDELVELLWRDGQVVLQSQARREPSVQVQTHKQETLRKPNNIFLDNQETVQKPNYAALDDQETVSWIQYPPDDVIDPFESEFSSHFFSSIDHLGGPEKPRTIEETVKHEAQAMAPPKFRSSVITVGPSHCGSNQSTNIHQATTLPVSMSDRSKNVEERLDTSSGGSSGCSYGRNNKETVSGTSVTIDRKRKHVMDADQESVSQSDIGLTSTDDQTMGNKSSQRSGSTRRSRAAEVHNLSERRRRDRINERMKALQELIPHCSRTDKASILDEAIDYLKSLQMQLQVMWMGSGMAAAAAAAASPMMFPGVQSSPYINQMAMQSQMQLSQFPVMNRSAPQNHPGLVCQNPVQLQLQAQNQILSEQLARYMGGIPQMPPAGNQMQTVQQQPADMLGFGSPAGPQSQLSAPATTDSLHMGKIG

SEQ ID NO: 945 - DNA, 930 bp, Arabidopsis thaliana
atgtttggtcgccattcgattatcccaaataaccagattggtaccgcctctgcttccgctggtgaagaccatgtctctgcctccgctacgtctggtcacattccttacgacgatatggaagaaatccctcatcctgactctatctatggtgctgcctccgatttgattcccgatggctctcaattggttgctcaccgatccgatggctctgaattacttgtttctcggccaccggaaggggcgaatcagcttacgatctcgttccgtggacaagtttacgtttttgatgccgttggtgctgacaaggtggatgctgtgttgtcgctgttgggtggttctactgagcttgctcctggtccgcaggtgatggaactagctcaacagcagaatcatatgcctgttgtagaatatcagagccgctgtagccttccgcaacgggcacaatccttggataggtttcggaagaagaggaatgctagatgtttcgagaagaaagtaagatacggtgttcgccaagaagttgccttaagaatggcacgtaataaaggtcaattcacctcttcaaagatgacagatggggcttataactctggcacagatcaagattctgcccaagatgatgcccatccagaaatatcgtgtactcattgcggcattagttccaaatgtacaccaatgatgcgacgtggcccttccggccccaggactctctgcaatgcctgtggacttttttgggctaacaggggtacattgagggatctctcaaagaaaacagaagagaatcagttggctttaatgaaaccggatgatggtgggagtgttgctgatgctgctaacaacttaaacactgaagctgcaagtgttgaagaacacacttccatggtttctcttgccaatggggataattctaatctgttaggtgatcactaa

SEQ ID NO: 946 - protein, 309 aa, Arabidopsis thaliana
MFGRHSIIPNNQIGTASASAGEDHVSASATSGHIPYDDMEEIPHPDSIYGAASDLIPDGSQLVAHRSDGSELLVSRPPEGANQLTISFRGQVYVFDAVGADKVDAVLSLLGGSTELAPGPQVMELAQQQNHMPVVEYQSRCSLPQRAQSLDRFRKKRNARCFEKKVRYGVRQEVALRMARNKGQFTSSKMTDGAYNSGTDQDSAQDDAHPEISCTHCGISSKCTPMMRRGPSGPRTLCNACGLFWANRGTLRDLSKKTEENQLALMKPDDGGSVADAANNLNTEAASVEEHTSMVSLANGDNSNLLGDH

SEQ ID NO: 947 - DNA, 603 bp, Arabidopsis thaliana
atggccgcgtttccgcagtggacaagggtcgatgacaaacgttttgagttagctctgcttcaaatcccggagggttcgccgaattttatagagaatatcgcctattatctccagaaaccggtgaaggaggtggagtactactactgcgcgttggtccatgatattgagcggatcgaatcgggtaagtatgttttgcccaaatacccggaagacgattacgtgaaactgacggaagcaggtgagtctaagggcaatgggaaaaagacgggaattccttggtcagaagaggaacagaggttgtttctggaaggactaaataagtttgggaaaggagactggaagaacatatcgaggtattgtgtgaagtcaaggacctcgacgcaagtggcaagccatgctcagaagtattttgcaaggcaaaagcaggagagtacgaatactaaacgcccgagtattcatgacatgactctgggagttgcggtcaatgtccctggatccaacttggagtctactggccagcaaccacattttggtgatcaaattccttcgaatcaatattatccctcccaggaaaactttcggggttttgatcagcgatggtga

SEQ ID NO: 948 - protein, 200 aa, Arabidopsis thaliana
MAAFPQWTRVDDKRFELALLQIPEGSPNFIENIAYYLQKPVKEVEYYYCALVHDIERIESGKYVLPKYPEDDYVKLTEAGESKGNGKKTGIPWSEEEQRLFLEGLNKFGKGDWKNISRYCVKSRTSTQVASHAQKYFARQKQESTNTKRPSIHDMTLGVAVNVPGSNLESTGQQPHFGDQIPSNQYYPSQENFRGFDQRW

SEQ ID NO: 949 - DNA, 1099 bp, Arabidopsis thaliana
tcgacccacgcgtccgcccacgcgtccggatcttttcacagaagaccaaccagcttggctcgatgagctcctaagtgagccagcatcacctaagattaacaaaggtcatagacgttcagctagtgacacagctgcttacttgaactcagctttaatgccttcgaaggaaaatcatgttgctggttcgtcttggcagttccagaactatgatttgtggcagtccaactcttatgaacaacacaataaattaggatgggatttctctacagcaaatggaactaatatccaaagaaatatgtcatgcggagctttaaatatgtcgtcgaaacccattgagaaacatgtaagcaaaatgaaagaaggaacttctacaaaaccagatggtcctagatcaaagactgactcaaaacgtatcaaacatcaaaatgctcatcgagcgcgtttgagaaggcttgagtacatatcagaccttgaaaggaccatccaagtgctacaagttgaaggatgtgaaatgtcatctgccattcactacttggatcagcagttactcatgcttagcatggaaaatagagctttaaaacaacgtatggatagtttagcagaaatccaaaagcttaaacatgtggagcagcaattgcttgagagagagataggaaacctacagtttcgacgacaccaacaacaaccacagcaaaaccaaaaacaagtccaagcaatacaaaatcgatacaccaaatatcaaccacctgttacacaagaacccgatgcccaatttgcagccttggcaatatgatttaggaaatatggatacattgttcagattaagctgagctcctcttgctctaccttaatgtccatacaacataggtgaacttgatgtttgtagccttgaatgaaaacctaaaaaagcatcgttatgtaaatcaaaatgtggttgcccatatcctcctctattgcatttctctctatttatggcatggtagagaatctcttgtcaagaaacttcatgttatgtaataacttgtaatccttcttatttcatctattatatatatgaataagtaatttttttgccaaaaaaaaaaaaaaaaaaaaaaaa

SEQ ID NO: 950 - protein, 212 aa, Arabidopsis thaliana
MPSKENHVAGSSWQFQNYDLWQSNSYEQHNKLGWDFSTANGTNIQRNMSCGALNMSSKPIEKHVSKMKEGTSTKPDGPRSKTDSKRIKHQNAHRARLRRLEYISDLERTIQVLQVEGCEMSSAIHYLDQQLLMLSMENRALKQRMDSLAEIQKLKHVEQQLLEREIGNLQFRRHQQQPQQNQKQVQAIQNRYTKYQPPVTQEPDAQFAALAI

SEQ ID NO: 951 - DNA, 1180 bp, Arabidopsis thaliana
ggaggttctttgacagacacatgtatcatcaatcttctctgttgaagcagagagagagagagctaattgttgcctctgagtcacatggataagaaagtttcatttactagctctgtggcacattcaactccaccataccttagtacttccatctcatggggacttccaaccaaatccaatggtgtgactgaatcactgagtttgaaggtggtagatgcaagaccagaacgtcttataaacacaaagaatatcagtttccaggaccaggattcatcttcaactctgtcctctgctcaatcttctaacgatgttacaagtagtggagatgataacccctcaagacaaatctcatttttagcacattcagatgtttgtaaaggatttgaagaaactcaaaggaagcgatttgcaattaaatcaggctcctccacggcaggaatcgctgatattcactcttctccttccaaggctaacttctcatttcactatgccgatccacattttggtggtttaatgcctgcggcttacctaccacaggcaacaatatggaatccccaaatgactcgagttccgctaccattcgatctcatagagaatgagcctgtctttgtcaatgcaaagcaattccatgcaattatgaggaggaggcaacagcgtgctaagctagaggcgcaaaacaaactaatcaaagcccgtaagccgtatcttcatgaatctcgacatgttcacgctcttaaacgacctagaggatctggtggaagattcctaaacaccaaaaagcttcaagaatctacagatccaaaacaagacatgccaatccaacagcaacacgcaacgggaaacatgtcaagatttgtgctttatcagttgcagaacagcaatgactgtgattgttcaaccacttctcgctctgacatcacatctgcttctgacagcgttaatctctttggacactctgaatttctgatatcagattgcccatctcagacaaacccaacaatgtatgttcatggtcaatcaaatgacatgcatggaggtaggaacacacaccatttctctgtccatatctgagccggtggaatctggtaatgtgtacgttcctacaaaaaaagggaagtcatccttggctgctacttcgcttattagctagttcttatttcacacgctttgtccagatatc

SEQ ID NO: 952 - protein, 328 aa, Arabidopsis thaliana
MDKKVSFTSSVAHSTPPYLSTSISWGLPTKSNGVTESLSLKVVDARPERLINTKNISFQDQDSSSTLSSAQSSNDVTSSGDDNPSRQISFLAHSDVCKGFEETQRKRFAIKSGSSTAGIADIHSSPSKANFSFHYADPHFGGLMPAAYLPQATIWNPQMTRVPLPFDLIENEPVFVNAKQFHAIMRRRQQRAKLEAQNKLIKARKPYLHESRHVHALKRPRGSGGRFLNTKKLQESTDPKQDMPIQQQHATGNMSRFVLYQLQNSNDCDCSTTSRSDITSASDSVNLFGHSEFLISDCPSQTNPTMYVHGQSNDMHGGRNTHHFSVHI

SEQ ID NO: 953 - DNA, 2104 bp, Arabidopsis thaliana
tcgatctttaaccaaatccagttgataaggtctcttcgttgattagcagagatctctttaatttgtgaatttcaattcatcggaacctgttgatggacaccaccattgatggattcgccgattcttatgaaatcagcagcactagtttcgtcgctaccgataacaccgactcctctattgtttatctggccgccgaacaagtactcaccggacctgatgtatctgctctgcaattgctctccaacagcttcgaatccgtctttgactcgccggatgatttctacagcgacgctaagcttgttctctccgacggccgggaagtttctttccaccggtgcgttttgtcagcgagaagctctttcttcaagagcgctttagccgccgctaagaaggagaaagactccaacaacaccgccgccgtgaagctcgagcttaaggagattgccaaggattacgaagtcggtttcgattcggttgtgactgttttggcttatgtttacagcagcagagtgagaccgccgcctaaaggagtttctgaatgcgcagacgagaattgctgccacgtggcttgccggccggcggtggatttcatgttggaggttctctatttggctttcatcttcaagatccctgaattaattactctctatcagaggcacttattggacgttgtagacaaagttgttatagaggacacattggttatactcaagcttgctaatatatgtggtaaagcttgtatgaagctattggatagatgtaaagagattattgtcaagtctaatgtagatatggttagtcttgaaaagtcattgccggaagagcttgttaaagagataattgatagacgtaaagagcttggtttggaggtacctaaagtaaagaaacatgtctcgaatgtacataaggcacttgactcggatgatattgagttagtcaagttgcttttgaaagaggatcacaccaatctagatgatgcgtgtgctcttcatttcgctgttgcatattgcaatgtgaagaccgcaacagatcttttaaaacttgatcttgccgatgtcaaccataggaatccgaggggatatacggtgcttcatgttgctgcgatgcggaaggagccacaattgatactatctctattggaaaaaggtgcaagtgcatcagaagcaactttggaaggtagaaccgcactcatgatcgcaaaacaagccactatggcggttgaatgtaataatatcccggagcaatgcaagcattctctcaaaggccgactatgtgtagaaatactagagcaagaagacaaacgagaacaaattcctagagatgttcctccctcttttgcagtggcggccgatgaattgaagatgacgctgctcgatcttgaaaatagagttgcacttgctcaacgtctttttccaacggaagcacaagctgcaatggagatcgccgaaatgaagggaacatgtgagttcatagtgactagcctcgagcctgaccgtctcactggtacgaagagaacatcaccgggtgtaaagatagcacctttcagaatcctagaagagcatcaaagtagactaaaagcgctttctaaaaccgtggaactcgggaaacgattcttcccgcgctgttcggcagtgctcgaccagattatgaactgtgaggacttgactcaactggcttgcggagaagacgacactgctgagaaacgactacaaaagaagcaaaggtacatggaaatacaagagacactaaagaaggcctttagtgaggacaatttggaattaggaaattcgtccctgacagattcgacttcttccacatcgaaatcaaccggtggaaagaggtctaaccgtaaactctctcatcgtcgtcggtgagactcttgcctcttagtgtaatttttgctgtaccatataattctgttttcatgatgactgtaactgtttatgtctatcgttggcgtcatatagtttcgctcttcgttttgcatcctgtgtattattgctgcaggtgtgcttcaaacaaatgttgtaacaatttgaaccaatggtatacagatttgtaatatatatttatgtacatcaacaataaaaaaaaaaaaaaaaaa

SEQ ID NO: 954 - protein, 593 aa, Arabidopsis thaliana
MDTTIDGFADSYEISSTSFVATDNTDSSIVYLAAEQVLTGPDVSALQLLSNSFESVFDSPDDFYSDAKLVLSDGREVSFHRCVLSARSSFFKSALAAAKKEKDSNNTAAVKLELKEIAKDYEVGFDSVVTVLAYVYSSRVRPPPKGVSECADENCCHVACRPAVDFMLEVLYLAFIFKIPELITLYQRHLLDVVDKVVIEDTLVILKLANICGKACMKLLDRCKEIIVKSNVDMVSLEKSLPEELVKEIIDRRKELGLEVPKVKKHVSNVHKALDSDDIELVKLLLKEDHTNLDDACALHFAVAYCNVKTATDLLKLDLADVNHRNPRGYTVLHVAAMRKEPQLILSLLEKGASASEATLEGRTALMIAKQATMAVECNNIPEQCKHSLKGRLCVEILEQEDKREQIPRDVPPSFAVAADELKMTLLDLENRVALAQRLFPTEAQAAMEIAEMKGTCEFIVTSLEPDRLTGTKRTSPGVKIAPFRILEEHQSRLKALSKTVELGKRFFPRCSAVLDQIMNCEDLTQLACGEDDTAEKRLQKKQRYMEIQETLKKAFSEDNLELGNSSLTDSTSSTSKSTGGKRSNRKLSHRRR

SEQ ID NO: 955 - DNA, 762 bp, Arabidopsis thaliana
atggagggttcgtccaaagggttgaggaaaggtgcatggactgctgaagaagatagtctcttgaggcagtgtattggtaagtatggagaaggcaaatggcatcaagttcctttaagagctgggctaaatcggtgcaggaaaagttgtagactaagatggttaaactatttgaagccaagtatcaagagaggaaaatttagttctgatgaagttgatcttcttcttcgtcttcataagcttctaggaaataggtggtccttgattgctggtcgattacctggtcggaccgctaatgatgtcaagaactactggaacacccatctgagtaagaagcatgaaccgtgttgtaaaactaagataaaaaggataaatattataacccctcctaatacaccggcccaaaaagtttgtgaaaatagtatcacatgtaacaaagatgatgagaaagatgattttgtggataattttatggttggagataatatatggttggagcgtttgctagacgagggccaagaggtagatgtgctggttacagaagcggcggcaacagaaaaggagggcactttggcgtttgacgttgagcaactttggaatttgttcgatggagagactgtgatctttgattagtgtttataaacgtttgtgttctcttgtttgtgaggtttctctatttaatttagtatctattttctaaattaactaatatcttatagtattttaggcaaaccttatgtttccgtttctgtgcggccgctctag

SEQ ID NO: 956 - protein, 209 aa, Arabidopsis thaliana
MEGSSKGLRKGAWTAEEDSLLRQCIGKYGEGKWHQVPLRAGLNRCRKSCRLRWLNYLKPSIKRGKFSSDEVDLLLRLHKLLGNRWSLIAGRLPGRTANDVKNYWNTHLSKKHEPCCKTKIKRINIITPPNTPAQKVCENSITCNKDDEKDDFVDNFMVGDNIWLERLLDEGQEVDVLVTEAAATEKEGTLAFDVEQLWNLFDGETVIFD

SEQ ID NO: 957 - DNA, 1838 bp, Arabidopsis thaliana
tccctcccagagtaagaacttccatactttgctctagatttcttgagaaaagatgcagccgatcttccatgcgatccttaaaaatgaccttccagcttttttagagttggtagaagatagtgaatcgtctctggaggagagaaacgaggaagaacacttgaacaacacggttttgcacatggctgcaaagtttggtcaccgagaactcgtctccaagattattgagctccgaccttccctcgtgtcttcccgcaacgcatacagaaacacacctttgcatcttgctgctatccttggagatgtaaacatagttatgcagatgttagagactggattggaagtgtgttctgcacgcaatatcaacaaccacacaccactccacttggcttgccgtagcaattccatagaggctgccagactcatcgcggaaaagacacaatcaattggcctcggtgaactcattctcgccatatcaagtggatccactagtatcgtagggactatactggagagattcccagacctagctagggaagaagcttgggtggttgaagacggctcacaatcaacgctactgcatcatgcgtgtgataagggagactttgaactgacaactatattgttagggctcgatcaaggattagaagaagcacttaaccccaatggtttatcacctctgcatcttgcggtcctcagaggctcggttgtgatcctggaggagttcttggacaaggttccattgtctttcagctcaatcacgccgtcgaaagagacagtctttcatctcgctgctcgaaacaaaaatatggatgcctttgtttttatggcagagagtttgggaattaacagccaaattcttctacagcaaaccgatgaaagtggcaacactgtcttacatattgctgcatccgtctcttttgatgctcctcttatacgttacattgttggtaagaatatagtagatatcacgtccaagaacaagatgggttttgaagcttttcaacttctccctcgagaagcccaagactttgagttgttatcaaggtggctgagatttggtaccgagacttcacaagagctggattctgagaacaatgtagaacaacacgaaggctctcaagaggtcgaggtaatacggttgctaaggattataggaataaacacatcagagatagcagagagaaagagaagcaaggaacaggaagtggaaagaggtcgtcagaacttggaatatcagatgcatatagaagcattacagaatgcaagaaatacgattgctatagtggcagtcttgattgcttcagttgcttatgccggtgggataaaccctccggggggcgtctaccaagacgggccatggagagggaaatccttagtggggaaaacaacggcgtttaaggtctttgcgatatgcaacaacatcgcactgttcacgtccttgggcatcgttattcttcttgttagcatcataccttacaagaggaaacccttaaagagattattggtggccacgcataggatgatgtgggtttctgtaggtttcatggcgacggcttatatagcggcgtcttgggtgaccataccgcattatcatggaacacaatggttatttccagcaattgtagccgttgctggtggagcgttgaccgtactctttttctatctcggagttgagaccatcggtcattggtttaagaagatgaatcgtgtaggggataatataccttcctttgcaagaaccagttcagatttagccgtctccggaaaatcaggctatttcacctattaagaaaaactggttttctaatttccctgtaacctgtgtaattgtgtatgtg

SEQ ID NO: 958 - protein, 578 aa, Arabidopsis thaliana
MQPIFHAILKNDLPAFLELVEDSESSLEERNEEEHLNNTVLHMAAKFGHRELVSKIIELRPSLVSSRNAYRNTPLHLAAILGDVNIVMQMLETGLEVCSARNINNHTPLHLACRSNSIEAARLIAEKTQSIGLGELILAISSGSTSIVGTILERFPDLAREEAWVVEDGSQSTLLHHACDKGDFELTTILLGLDQGLEEALNPNGLSPLHLAVLRGSVVILEEFLDKVPLSFSSITPSKETVFHLAARNKNMDAFVFMAESLGINSQILLQQTDESGNTVLHIAASVSFDAPLIRYIVGKNIVDITSKNKMGFEAFQLLPREAQDFELLSRWLRFGTETSQELDSENNVEQHEGSQEVEVIRLLRIIGINTSEIAERKRSKEQEVERGRQNLEYQMHIEALQNARNTIAIVAVLIASVAYAGGINPPGGVYQDGPWRGKSLVGKTTAFKVFAICNNIALFTSLGIVILLVSIIPYKRKPLKRLLVATHRMMWVSVGFMATAYIAASWVTIPHYHGTQWLFPAIVAVAGGALTVLFFYLGVETIGHWFKKMNRVGDNIPSFARTSSDLAVSGKSGYFTY

SEQ ID NO: 959 - DNA, 436 bp, Arabidopsis thaliana
tcgacctcgtttcctttcctcctctcttcctaccattagtacgttactggagctgatctcacgtatattttggatcgtaatcatggacggcgaagattttgccggaaaggcggctgctgaagccaagggattgaacccgggattaatcgtgctgcttgttgttggaggtccgcttcttgtgttcctaatcgccaactacgtgctttacgtttatgctcagaagaacctacctccaaggaagaagaagcccgtttccaaaaagaagctcaagcgggagaagctaaagcaaggagtccctgtccctggagaataaaagccagcttaagcttccttcacttgtgcctccttcaaagcggtttttgttcggttaccaaatttcacccttgcgggtttttttcttcctttacttctgtcatgaggattatctttgaggcct

SEQ ID NO: 960 - protein, 76 aa, Arabidopsis thaliana
MDGEDFAGKAAAEAKGLNPGLIVLLVVGGPLLVFLIANYVLYVYAQKNLPPRKKKPVSKKKLKREKLKQGVPVPGE

SEQ ID NO: 961 - DNA, 3001 bp, Arabidopsis thaliana
atttttttccaatctgcaaattttagtctatgtctgttccttgtgctccctcttctcagtacctgcaaatggaggaagaagaatccttctctgaaacccttgttctcatttgattcctccttcctctctcttcttctctctctgtctctgattcgttattccacacttatgactcatctttcccgtcaatagctaagtttgcctcttctttgtgaaatttagctgaaaaaggagaggaattccgaattctgtcacttcaaagctcgaattttgcaaactttcctttgatgggttttacttgttttgttgtaatctgattaaaaatagaaactttttgttttcttcttgtctccttttgctcttaaaagagaagctttttcaatggaatttgacttgaatactgagattgcggaggtggaagaggaggagaatgatgatgtaggagtaggagtaggaggaggaacaagaattgacaagggtaggcttggaatttcaccatcttcttcttcttcatgctcttccggatcatcatcgtcatcatcttctacaggctctgcatcttccatttactctgagctttggcatgcttgtgctggtcctctcacttgtcttcccaagaaaggcaatgtagttgtctatttccctcaaggtcatttggagcaagatgctatggtttcatattcgtctcctcttgaaatccccaaatttgaccttaatccccaaatcgtctgcagggtggttaatgtccagttgcttgctaataaggacaccgatgaggtctacactcaagtcactctgcttccacttcaagagttttcgatgctaaatggggaggggaaagaggtcaaggagttaggaggggaggaagagaggaacggaagctcatccgtcaagcggacacctcatatgttctgtaaaaccttaacagcgtctgacacaagcacacatggaggcttctctgtacctagaagagccgctgaagattgttttgctcctcttgactacaaacaacagaggccatctcaagagctcattgcaaaggacctccatggagtagagtggaagtttcgccatatctatagaggtcaaccaaggaggcatctactcaccactggttggagtatctttgtcagtcaaaagaatctcgtctctggtgatgcggttctctttctgagagacgaaggaggagagctgagattaggaatcagaagagcagcacggccaagaaatggacttcctgactcaatcattgagaagaattcatgttcaaacattctgtctcttgtggctaatgctgtatctacaaaaagcatgtttcatgtgttctacagtccacgagcgacgcatgcagagtttgtgattccttatgagaagtatatcacaagcatcaggagtcctgtttgcataggcacaagatttagaatgcgatttgaaatggacgattctcctgagagaagatgcgctggtgtagtgactggagtctgtgacttggacccgtataggtggccaaactctaaatggaggtgcttgttggtgcgatgggatgagtcttttgtgagtgatcatcaagaaagagtttcaccttgggagattgatccctcggtttctctcccacacttgagcattcagtcatctccaaggcctaaaaggccatgggcaggtttactggatactaccccacccggaaaccccataacaaaaaggggtggttttttggactttgaggagtcggttagaccctctaaggtcttgcaaggtcaagaaaatataggttctgcatcaccctcacaggggtttgatgttatgaaccgccggatactggattttgcgatgcagtctcatgcaaatccagtccttgtgtcgagtagagtcaaggatcgatttggtgagtttgtagatgctactggcgtgaacccagcttgttcaggtgttatggacctggataggtttccaagggtcttgcaaggtcaagaaatttgctcgcttaaatcattcccgcaatttgctggtttcagtccagctgctgctcctaatccctttgcttaccaagccaacaagtcaagttactatccgctagctttgcatgggattaggagcactcatgttccgtatcagaatccatacaatgcgggaaaccaatcctcgggtcccccttcacgtgcaataaactttggtgaagagactagaaagtttgatgcacaaaatgaaggtggcctaccaaataatgttacagctgatttgccattcaagattgatatgatgggaaaacagaaaggcagtgagttgaatatgaatgcttcatcaggatgtaaacttttcggattctccttaccagtggagacacctgcatctaagccgcaaagctcgagcaaaagaatctgtacaaaggttcacaagcaaggaagccaagtggggagagctattgatttgtcgcgacttaacgggtatgatgatctccttatggagcttgaacggctgttcaacatggaagggcttctcagggatcctgaaaaaggatggaggatcttatatactgatagtgagaacgatatgatggtcgttggcgatgatccatggcatgatttctgcaatgtggtgtggaagatacacttatacacgaaagaggaagtggagaatgcgaatgacgataacaagagttgtttagagcaagctgctctcatgatggaagcatcaaagtcatcttctgtgagccagcctgattcttctcctacaatcactagggtttgatacccataaagaagcttatttcctatgttttaaagtgtgttttgctcacaaaagaacttcaactttatctttgtctttgaatccatttatgtgtttgtttgtgtttcttctggtctccatggatgtctcatgtgtaccgttttactcgagagatatgtgagtttatgggatgtgtaaagcatgccattggattttaaggttttcaaaattacaatatatatattagttttgaagttaaaaaaaaaaaaaaaaa

SEQ ID NO: 962 - protein, 788 aa, Arabidopsis thaliana
MEFDLNTEIAEVEEEENDDVGVGVGGGTRIDKGRLGISPSSSSSCSSGSSSSSSSTGSASSIYSELWHACAGPLTCLPKKGNVVVYFPQGHLEQDAMVSYSSPLEIPKFDLNPQIVCRVVNVQLLANKDTDEVYTQVTLLPLQEFSMLNGEGKEVKELGGEEERNGSSSVKRTPHMFCKTLTASDTSTHGGFSVPRRAAEDCFAPLDYKQQRPSQELIAKDLHGVEWKFRHIYRGQPRRHLLTTGWSIFVSQKNLVSGDAVLFLRDEGGELRLGIRRAARPRNGLPDSIIEKNSCSNILSLVANAVSTKSMFHVFYSPRATHAEFVIPYEKYITSIRSPVCIGTRFRMRFEMDDSPERRCAGVVTGVCDLDPYRWPNSKWRCLLVRWDESFVSDHQERVSPWEIDPSVSLPHLSIQSSPRPKRPWAGLLDTTPPGNPITKRGGFLDFEESVRPSKVLQGQENIGSASPSQGFDVMNRRILDFAMQSHANPVLVSSRVKDRFGEFVDATGVNPACSGVMDLDRFPRVLQGQEICSLKSFPQFAGFSPAAAPNPFAYQANKSSYYPLALHGIRSTHVPYQNPYNAGNQSSGPPSRAINFGEETRKFDAQNEGGLPNNVTADLPFKIDMMGKQKGSELNMNASSGCKLFGFSLPVETPASKPQSSSKRICTKVHKQGSQVGRAIDLSRLNGYDDLLMELERLFNMEGLLRDPEKGWRILYTDSENDMMVVGDDPWHDFCNVVWKIHLYTKEEVENANDDNKSCLEQAALMMEASKSSSVSQPDSSPTITRV

SEQ ID NO: 963 - DNA, 962 bp, Arabidopsis thaliana
gtaatatataacaataactcaggttacaaaggatggttccgaaagtggtcgacctacaaaggatagcgaacgataagacaaggataacaacttacaagaagaggaaagctagtctttacaagaaggcacaagagttctcaactctctgcggcgtcgagacatgtctcatcgtctacggtcccacgaaggctaccgatgtggtgatttccgagccagagatatggccgaaggacgagaccaaagtcagggccatcatacgcaagtacaaagacacagtgtcgaccagctgcaggaaagaaaccaacgtggagactttcgtcaacgatgtagggaaaggaaacgaggtggtgactaaaaagagagtgaagcgtgagaataagtattctagttgggaggagaagctagacaagtgttcacgagagcaactacatgggattttctgtgccgtggatagcaagttaaatgaagctgtaacgagacaggagcgtagtatgtttagggttaatcatcaagccatggacacaccattcccgcagaatttaatggaccaacaattcatgccacagtattttcatgagcagccacagtttcaaggcttccctaataatttcaataatatgggtttctcgttgatttcacctcatgatggtcagattcaaatggacccaaatctcatggagaagtggaccgacttggctttgactcaaagcttgatgatgtcaaagggaaacgatggtactcaattcatgcagaggcaagaacaaccatactataatcgtgaacaggttgtatcgaggtctgcaggtttcaatgttaacccgtttatgggatatcaagtcccgtttaatattcctaattggagattatcgggaaatcaagttgaaaattgggagctttcagggaagaaaacgatatgatttgaattacggagctttattagtttttagggttttatagttttg

SEQ ID NO: 964 - protein, 294 aa, Arabidopsis thaliana
MVPKVVDLQRIANDKTRITTYKKRKASLYKKAQEFSTLCGVETCLIVYGPTKATDVVISEPEIWPKDETKVRAIIRKYKDTVSTSCRKETNVETFVNDVGKGNEVVTKKRVKRENKYSSWEEKLDKCSREQLHGIFCAVDSKLNEAVTRQERSMFRVNHQAMDTPFPQNLMDQQFMPQYFHEQPQFQGFPNNFNNMGFSLISPHDGQIQMDPNLMEKWTDLALTQSLMMSKGNDGTQFMQRQEQPYYNREQVVSRSAGFNVNPFMGYQVPFNIPNWRLSGNQVENWELSGKKTI

SEQ ID NO: 965 - DNA, 1755 bp, Arabidopsis thaliana
atggcttacatgtgcactgatagtggcaatctaatggctattgctcaacaagtcatcaaacagaagcagcaacaagaacaacaacagcagcaacatcatcaagaccatcagatttttggtattaatcctttgtctcttaacccatggcccaatacttccctcgggtttgggctttcaggttcggcttttcccgacccgtttcaagttaccggcggcggagattccaacgatcctggctttccttttcctaacttagaccaccaccacgccacaaccaccggcggtgggttcaggttatctgatttcggcggtggaaccggcggcggcgagtttgagtccgacgagtggatggagactcttatcagcggtggagactccgttgcagacggtcctgattgtgacacctggcatgataatcccgattacgtaatctacggtcctgatccattcgatacttacccgagtcgactcagtgtccaaccgtcagatctaaaccgagtcattgacacgtcgagtccgcttcctccgccgaccttgtggcctccttcttcgccattatcgattcctccgcttactcatgagtcaccaaccaaagaagatccagagactaacgactccgaagacgatgacttcgacctagaaccacctctcctcaaagctatatacgactgtgcacggatctcagactctgaccctaacgaagcttccaagacgcttcttcagatccgagaatctgtatcggagctaggtgatccgacggagcgagttgcattttacttcacggaagctctctccaacagactgtctcctaattcgccggcgacgtcgtcttcttcttcatctacggaggatttaatcttatcttataaaaccctaaacgacgcttgtccttactccaaattcgcacatttgacggcgaatcaagcgattctagaagcgacggagaagtcgaacaagattcacatcgtcgattttggaatcgttcaaggtatacaatggcctgctcttcttcaagctctagctactcgtacttctggtaaacccactcaaatccgggtctcgggtatacccgctccatctctcggtgaatctccggaaccgtcgttaatcgccaccggaaaccgcctccgtgatttcgccaaggttctggatctgaatttcgatttcatcccaattctcactcccatacatttacttaacgggtcaagtttccgggtcgacccggatgaagtactggccgtgaatttcatgctccagctctacaaattactcgacgagacgccgacgatagttgacaccgcactacggctcgccaaatcgttgaacccgagggtcgtcactctcggagaatacgaagtgagcttaaaccgggtcggtttcgctaaccgggtaaagaacgcgcttcaattctattccgcggttttcgaatcccttgaaccgaacttggggcgtgattcggaggagagagtgagagttgagcgagagttgttcggccggagaatctcgggtttgattggaccggagaaaaccggaattcatagagaaagaatggaagagaaagagcaatggcgggtattaatggagaatgccggttttgaatcggttaagctgagtaattacgcagtgagccaagcgaagattctattgtggaattacaattacagcaatttgtattcaattgttgaatctaagcctggcttcatctctttggcctggaacgatttacctctcctcactctttcttcctggcgataa

SEQ ID NO: 966 - protein, 584 aa, Arabidopsis thaliana
MAYMCTDSGNLMAIAQQVIKQKQQQEQQQQQHHQDHQIFGINPLSLNPWPNTSLGFGLSGSAFPDPFQVTGGGDSNDPGFPFPNLDHHHATTTGGGFRLSDFGGGTGGGEFESDEWMETLISGGDSVADGPDCDTWHDNPDYVIYGPDPFDTYPSRLSVQPSDLNRVIDTSSPLPPPTLWPPSSPLSIPPLTHESPTKEDPETNDSEDDDFDLEPPLLKAIYDCARISDSDPNEASKTLLQIRESVSELGDPTERVAFYFTEALSNRLSPNSPATSSSSSSTEDLILSYKTLNDACPYSKFAHLTANQAILEATEKSNKIHIVDFGIVQGIQWPALLQALATRTSGKPTQIRVSGIPAPSLGESPEPSLIATGNRLRDFAKVLDLNFDFIPILTPIHLLNGSSFRVDPDEVLAVNFMLQLYKLLDETPTIVDTALRLAKSLNPRVVTLGEYEVSLNRVGFANRVKNALQFYSAVFESLEPNLGRDSEERVRVERELFGRRISGLIGPEKTGIHRERMEEKEQWRVLMENAGFESVKLSNYAVSQAKILLWNYNYSNLYSIVESKPGFISLAWNDLPLLTLSSWR

SEQ ID NO: 967 - DNA, 1148 bp, Arabidopsis thaliana
aatcccctatccttcgcaagacccttcctctatataaggaagttcatttcatttttttttgacacgctgacaagctgactctagcatatctggcaccggcgaccagtccttctttggtgcaaagatcccaaaaaatcaaaatcgaaagagagaataaatcaaaaggaagaatctttatctgctttctctcgatgaggatccggaaacgacaagtgcctcttcctttatcgtctctattaccagttcctctatcagatctctactttaaccgctcaccgacggccaccgcgagatactttcgcggtggttataaagacggcggtgatgattttggttctcttcagctttcgcttccgccgccgtcgcagatttctgatcggcttattcaaagagatttgataaagaagaaggaggaggtcaaggctttggatgatgataatggtgatgtagacgtcaagagtcgtactgatgcatcgggcagcaagaatgttaatccccgaggagaatccgtctcttcaatacaagttgtcgagaagaatgaaaaggttgtgtctttgaggaagagaagaggctttatcaactttgaggattacgaagatgaggaagatgaagaagctagtggcggtggaggccgtattaataaagggaaaaagaaagcgaaaaagagcggtggtgggttagaggaaggatcacggtgcagccgtgttaacggtagaggatggagatgttgtcagcaaacgcttgttggttattctctttgtgagcatcatctcggtaaaggaagggtaaggagcatgaacaagagtggtggtggtcgtggcggcgagaaaaaggcggtggtggtggaagtgaagaagaagagagtaaagcttggcatggtaaaggcacgttcaataagtagtttgcttggacaaaccagcactagtggtggtactagtggtgatgttgatcagggtgagataagtgcacctgctgatcagttcgctgcatgtgataagtaggtctgttgatcagcatttgcatgtatatggatatgtgtatgtttatgtacatgatgataatgggcatagcgcggccgctctagacaggcctggaaccggatcctctagctagagctttcgttagtatcatcgggtttagacaacgtt

SEQ ID NO: 968 - protein, 269 aa, Arabidopsis thaliana
MRIRKRQVPLPLSSLLPVPLSDLYFNRSPTATARYFRGGYKDGGDDFGSLQLSLPPPSQISDRLIQRDLIKKKEEVKALDDDNGDVDVKSRTDASGSKNVNPRGESVSSIQVVEKNEKVVSLRKRRGFINFEDYEDEEDEEASGGGGRINKGKKKAKKSGGGLEEGSRCSRVNGRGWRCCQQTLVGYSLCEHHLGKGRVRSMNKSGGGRGGEKKAVVVEVKKKRVKLGMVKARSISSLLGQTSTSGGTSGDVDQGEISAPADQFAACDK

SEQ ID NO: 969 - DNA, 1009 bp, Arabidopsis thaliana
gatagtgataacgaaatcctaattccatggccgacaacgacggagcagtgagtaacggcatcatagtcgagcagacgtcaaacaaaggacctcttaacgccgttaagaaaccaccgtctaaagatcgacacagcaaagttgacggaagaggaagaaggattcgtatgccaatcatttgcgcagctcgagtttttcaattgaccagagagttaggtcacaagtccgatggtcaaaccatagagtggcttctccgtcaagctgagccttctatcatagccgccactggaactggcactactccggcgagtttctccactgcttctctctccacttcttctccgtttactctcgggaaacgtgtcgtcagagcggaggaaggagaatccggcggcggaggaggaggagggttaacagtgggacacacaatggggacttcgttaatgggtggtggtggttctggtgggttttgggctgttccggcgaggccggatttcggacaagtctggagctttgcaaccggagctccaccggaaatggtttttgcgcagcagcagcaaccagctacactcttcgtccgccaccagcagcaacagcaagcttccgccgccgcagcagctgcaatgggtgaggcttcagcagctagagttgggaattatcttccgggtcatcatctcaatttgcttgcttctttgtctggtggagctaacgggtcgggtcggagggaagacgaccacgaaccacgttgagaaatggtattgtctttttggtaatgtatagaaaaattcctatgttttatgtcatcgaaagtgtttagaaagtacctctaatttgcggtttcttttgctccttttttacttaatttaagcttattgcttgtttgattagggttttagggtttaagaatatttggtctcgttaatttgtttcggagagtgatagaaagagagagagattgattgattgttgtacctaaaacgctataaaagctctgtttttactagcgaaaaaa

SEQ ID NO: 970 - protein, 239 aa, Arabidopsis thaliana
MADNDGAVSNGIIVEQTSNKGPLNAVKKPPSKDRHSKVDGRGRRIRMPIICAARVFQLTRELGHKSDGQTIEWLLRQAEPSIIAATGTGTTPASFSTASLSTSSPFTLGKRVVRAEEGESGGGGGGGLTVGHTMGTSLMGGGGSGGFWAVPARPDFGQVWSFATGAPPEMVFAQQQQPATLFVRHQQQQQASAAAAAAMGEASAARVGNYLPGHHLNLLASLSGGANGSGRREDDHEPR

SEQ ID NO: 971 - DNA, 883 bp, Arabidopsis thaliana
ctgaattcgaactttggaagaagaagaagctttgatcaatcatggaaattgcaaccgatacagcaaagcagatgagagacgaagagttgttcaaagcagcggaatggggagattcatcgttgttcatgtcattatctgaagaacagctctctaaatctctcaatttcagaaacgaagatggtcgctctctcctccatgtcgctgcttccttcggccattctcaaatagtgaagttgttatcaagttcagatgaagcaaagactgtaatcaatagcaaggatgatgaaggatgggctcctttgcattccgctgctagcatcggtaatgctgagctcgttgaggtgcttttgaccagaggtgctgatgtcaatgccaaaaataacggtggtcgcactgctcttcactatgctgctagcaaaggccggttggagattgctcagcttttattaacacacggtgcaaagattaacatcacagacaaggttggttgcactccgcttcacagggcagcaagcgtgggaaagttagaagtttgtgaatttcttattgaagaaggagcagagatcgatgctacggataaaatgggtcaaactgcactcatgcattcagttatctgcgatgacaaacaggttgcgttcctgcttataagacatggtgcagatgtggatgtagaagacaaggaaggctacactgttctaggccgagctaccaatgaattccgacctgcacttatcgatgctgctaaggccatgcttgaaggataaaatgactctggattactttaaaacttactaactctgagagttgtttagttacttaaaaggatttttctttactgtatcatgtttgcaaaatgtttctgccttatcaattcatgttctgt

SEQ ID NO: 972 - protein, 240 aa, Arabidopsis thaliana
MEIATDTAKQMRDEELFKAAEWGDSSLFMSLSEEQLSKSLNFRNEDGRSLLHVAASFGHSQIVKLLSSSDEAKTVINSKDDEGWAPLHSAASIGNAELVEVLLTRGADVNAKNNGGRTALHYAASKGRLEIAQLLLTHGAKINITDKVGCTPLHRAASVGKLEVCEFLIEEGAEIDATDKMGQTALMHSVICDDKQVAFLLIRHGADVDVEDKEGYTVLGRATNEFRPALIDAAKAMLEG

SEQ ID NO: 973 - DNA, 2022 bp, Arabidopsis thaliana
cgtcgacatgttcatatttgtttctagctaagaagtttgtataaggcagtggacatggctcctgtttcaatgcctccaggtttccggtttcatccaacagacgaagagcttgtcatatactacctcaagcgaaagattaatggtcggactattgagttagagataatacccgagattgatctttacaaatgcgaaccttgggatttacctgggaagtccttgctgccaagtaaagacctagaatggttctttttcagtcctcgagaccggaaatatccaaacggatcaagaacaaaccgggcgaccaaagcaggttactggaaagccaccgggaaagatcgtaaagtgacttcacattcacggatggttggaacaaagaaaacattagtttattaccgaggaagagcgcctcatggctctcgtaccgattgggtcatgcacgagtaccgtcttgaagaacaagaatgtgactctaaatccggtatacaggatgcctatgcactttgtcgagtatttaagaagagtgctttagccaacaaaattgaagaacaacaccatggtacgaagaagaacaaaggaacgactaatagtgaacaatctacttctagtacttgtttgtattctgatggaatgtatgaaaacctcgaaaactcggggtatccagtctcacctgagacaggaggcttaactcaactcggtaataattcgtcgtcggatatggaaacgatagagaataaatggagtcagtttatgtcgcatgacacgtccttcaacttcccacctcagtctcaatatggaacaatctcatatcctccctcgaaggttgatatagcgttagagtgtgcaagactacaaaatcgtatgttgccaccagtaccaccactttacgtagaaggtctcacacacaatgaatattttggaaacaatgtagctaacgatacagatgaaatgttgagcaagattatagcattggctcaagcctcacatgagccacgaaacagtctagactcatgggacggtggttctgcttccgggaacttccatggagactttaactattccggagaaaaagtctcatgcctagaggcgaacgtggaggctgtagatatgcaagaacaccatgtgaattttaaggaagaaagacttgttgaaaacttgagatgggtaggagtatcaagcaaggaacttgaaaagagcttcgttgaagaacactcaacggtaattcctatagaagatatttggagatatcataatgataatcaagaacaagaacatcatgatcaagatggtatggacgttaacaacaacaatggagatgtggatgatgctttcacactcgagttttcggaaaacgaacataacgagaatcttttggacaagaacgatcatgagacaacgagttcctcatgttttgaggtggtaaaaaaagttgaggttagccatggattgtttgtcacaactcgtcaggtaaccaacacattcttccaacagatagtaccatcgcaaaccgttatagtttatataaatccgacggatggcaatgagtgttgtcatagtatgacatcaaaagaggaggttcatgtccgtaaaaagataaatccgcgaatcaacggagtaagctcaacagttcttggacaatggagaaaattcgcgcatgttattggcttcattcctatgcttctattgatgcgttgtgttcatcgaggtaactctaacaaaaacagaggcagtgaaggttactcgaggcagcctacgagaggagattgtaacaatcggggaacaatactcatgatggaaaatgctgtcgtgagaagaaaaatttggaagaagaagaaagagaaaaatatggttgacgaacaaggttttcggtttcaagatagtttcgtattgaagaagttggggctttctcttgctatcatcttagctgtttctaccataagtcttatttgaatactgaggttcaatatatcatatatggcttttcacttttctattgtactcccatttgcctaggtcgtatgc

SEQ ID NO: 974 - protein, 631 aa, Arabidopsis thaliana
MAPVSMPPGFRFHPTDEELVIYYLKRKINGRTIELEIIPEIDLYKCEPWDLPGKSLLPSKDLEWFFFSPRDRKYPNGSRTNRATKAGYWKATGKDRKVTSHSRMVGTKKTLVYYRGRAPHGSRTDWVMHEYRLEEQECDSKSGIQDAYALCRVFKKSALANKIEEQHHGTKKNKGTTNSEQSTSSTCLYSDGMYENLENSGYPVSPETGGLTQLGNNSSSDMETIENKWSQFMSHDTSFNFPPQSQYGTISYPPSKVDIALECARLQNRMLPPVPPLYVEGLTHNEYFGNNVANDTDEMLSKIIALAQASHEPRNSLDSWDGGSASGNFHGDFNYSGEKVSCLEANVEAVDMQEHHVNFKEERLVENLRWVGVSSKELEKSFVEEHSTVIPIEDIWRYHNDNQEQEHHDQDGMDVNNNNGDVDDAFTLEFSENEHNENLLDKNDHETTSSSCFEVVKKVEVSHGLFVTTRQVTNTFFQQIVPSQTVIVYINPTDGNECCHSMTSKEEVHVRKKINPRINGVSSTVLGQWRKFAHVIGFIPMLLLMRCVHRGNSNKNRGSEGYSRQPTRGDCNNRGTILMMENAVVRRKIWKKKKEKNMVDEQGFRFQDSFVLKKLGLSLAIILAVSTISLI

SEQ ID NO: 975 - DNA, 1722 bp, Arabidopsis thaliana
atgactgttgaacaaaatttagaagctttggatcagtttcctgtaggaatgagagttcttgctgttgatgatgaccaaacttgtctcaaaatccttgaatctctccttcgtcactgccaataccatgtaacaacgacgaaccaagcacaaaaggctttagagttattgagagagaacaagaacaagtttgatctggttattagtgatgttgacatgcctgacatggatggtttcaaactccttgagcttgttggtcttgaaatggacctacctgtcataatgttgtctgcgcatagtgatccaaagtatgtgatgaagggagttactcatggtgcttgtgattatctactgaagccggttcgtattgaggagttgaagaacatatggcaacatgtcgtgagaagtagatttgataagaaccgtgggagtaataataatggtgataagagagatggatcaggtaatgaaggtgttgggaattctgatccgaacaatgggaaaggtaatagaaaacgtaaagatcagtataatgaagatgaggatgaggatagagatgataatgatgattcgtgtgctcaaaagaagcaacgtgttgtttggactgttgagctgcataagaaatttgttgcagctgttaaccaattgggatatgagaaggctatgcctaaaaagattttggatctgatgaatgttgagaagctcactagagaaaatgtggccagtcatcttcagaaattccgcctttacttgaagaggatcagtggtgtggctaatcagcaagctattatggcaaactctgagttacattttatgcaaatgaatggacttgatggtttccatcaccgcccaatccctgttggatctggtcagtaccatggtggggctcctgcaatgagatctttccctccaaacgggattcttggcagactcaatagctcttcggggatcggtgtccgcagcctttcttctcctcctgcaggaatgttcttgcaaaaccagaccgatatcggaaagtttcaccatgtctcatcacttcctcttaaccacagtgatggaggaaacatacttcaagggttgccaatgcctttagagttcgaccagcttcagacaaacaacaacaaaagtagaaacatgaacagtaacaagagcattgctgggacctccatggcttttcctagcttctctacgcaacaaaactcgctcatcagtgctcctaataacaatgtcgtggttctagaaggtcacccacaagcaactcctccaggcttcccaggacaccagatcaataaacgtttggagcattggtcaaatgctgtatcctcttcgactcaccctcctcccccggcacataacagtaatagtatcaatcatcagttcgatgtctctccattaccgcattctagacccgaccccttggaatggaacaatgtgtcatcaagctactctataccattctgtgactctgccaatacattgagttctccagccttggatacaacaaatccccgagctttctgtagaaacacggacttcgattcaaacacaaatgtgcaacctggagtcttttatggtccatccacggatgctatggctctgttgagtagtagtaacccgaaagaagggttcgtcgtaggccaacagaagttacagagtggtggattcatggttgcagatgctggttccttagatgatatagtcaactccacgatgaagcaggtgtga

SEQ ID NO: 976 - protein, 573 aa, Arabidopsis thaliana
MTVEQNLEALDQFPVGMRVLAVDDDQTCLKILESLLRHCQYHVTTTNQAQKALELLRENKNKFDLVISDVDMPDMDGFKLLELVGLEMDLPVIMLSAHSDPKYVMKGVTHGACDYLLKPVRIEELKNIWQHVVRSRFDKNRGSNNNGDKRDGSGNEGVGNSDPNNGKGNRKRKDQYNEDEDEDRDDNDDSCAQKKQRVVWTVELHKKFVAAVNQLGYEKAMPKKILDLMNVEKLTRENVASHLQKFRLYLKRISGVANQQAIMANSELHFMQMNGLDGFHHRPIPVGSGQYHGGAPAMRSFPPNGILGRLNSSSGIGVRSLSSPPAGMFLQNQTDIGKFHHVSSLPLNHSDGGNILQGLPMPLEFDQLQTNNNKSRNMNSNKSIAGTSMAFPSFSTQQNSLISAPNNNVVVLEGHPQATPPGFPGHQINKRLEHWSNAVSSSTHPPPPAHNSNSINHQFDVSPLPHSRPDPLEWNNVSSSYSIPFCDSANTLSSPALDTTNPRAFCRNTDFDSNTNVQPGVFYGPSTDAMALLSSSNPKEGFVVGQQKLQSGGFMVADAGSLDDIVNSTMKQV

SEQ ID NO: 977 - DNA, 1153 bp, Arabidopsis thaliana
aaccacacaaaacaaaacaaaaaaacatattgatggggatgaagaaggtaaagctatctttgatagctaatgaaagatcaaggaaaacatccttcatgaagaggaaaaacgggatattcaagaaactccacgagttgtcaactctatgtggtgtccaagcttgtgctctcatctatagtccattcataccggttccagagtcatggccgtcaagggaaggtgctaaaaaggtagcttcaaagtttctggagatgccgcggacagcccgaaccaggaagatgatggatcaagaaacccatcttatggagaggattaccaaagcaaaagagcaactaaagaatttggctgctgagaaccgagaattacaggttagacgatttatgtttgattgtgttgaaggcaaaatgtcccagtatcgttatgatgcaaaagaccttcaagatttgctatcttgtatgaatctatatctcgatcagcttaacggaaggatcgagtccattaaagaaaacggtgagtcgttgttgtcttccgtctctccttttcctactagaattggtgttgacgaaattggtgatgagtcgttttccgactctcctattcattctacaactagggttgtagatactcctaatgctaccaatcctcatgttcttgcgggcgatatgactccttttcttgatgcggacgcaaatgcggtaactgctcccagtcgattttctgatcatattcaatatgaaaatatgaatatgagtcaaaatctgcatgaaccgtttcaacaccttgttcctactaacgtttgtgatttttatcaaaatcagaatatgaatcaggttcaataccaggctcctaataatctgtttaatcagattcaacgagaattctacaacataaatttgaatctgaatttgaatctgaattcaaatcagtatctgaatcaacaacaatcattcatgaatccgatggtggaacaacatatgaatcatgttggagggcgtgaaagcattcctttcgtggacagaaactactacaactacaatcaactaccagccgttgatcttgcttccaccagttacatgccttcaaccaccgatgtttatgatccttacatcaacaacaatctctaatcacaaaagacggagattttctagtttaa

SEQ ID NO: 978 - protein, 363 aa, Arabidopsis thaliana
MGMKKVKLSLIANERSRKTSFMKRKNGIFKKLHELSTLCGVQACALIYSPFIPVPESWPSREGAKKVASKFLEMPRTARTRKMMDQETHLMERITKAKEQLKNLAAENRELQVRRFMFDCVEGKMSQYRYDAKDLQDLLSCMNLYLDQLNGRIESIKENGESLLSSVSPFPTRIGVDEIGDESFSDSPIHSTTRVVDTPNATNPHVLAGDMTPFLDADANAVTAPSRFSDHIQYENMNMSQNLHEPFQHLVPTNVCDFYQNQNMNQVQYQAPNNLFNQIQREFYNINLNLNLNLNSNQYLNQQQSFMNPMVEQHMNHVGGRESIPFVDRNYYNYNQLPAVDLASTSYMPSTTDVYDPYINNNL

SEQ ID NO: 979 - DNA, 1225 bp, Arabidopsis thaliana
gggatttgactttagcacttcaaaatccaaagctaaaagacaaaaaagaatagaggttcgatttgcatctccattaatgggcatcgatctttctcttaagctcgaggccgaggagaaaaagaaagagatagaaggatcgaaacatagccgtgagaacaaagaagacgaagaacatgatgctagtggtgatgaagatgaacaaatggtgaaagaagacgaagatgattcttcttctttaggtttaagaacccgagaagaagaaaacgaacgtgaagagctcttgcagctacagatccagatggaaagtgtgaaagaagagaatactaggttgaggaagcttgtcgagcagactcttgaagattatcgtcatcttgagatgaaattcccggttatcgataaaaccaagaagatggatcttgaaatgttccttggagtacaaggcaaacgatgtgtggatataacaagtaaggctcggaaaagaggagctgagagatctccgtcaatggaaagagaaatagggctttcactttctctagagaaaaaacagaaacaagaagagagcaaagaagctgttcagtctcatcaccaaagatacaatagtagcagcttagatatgaatatgccacgtatcatttcatcttctcaaggtaatagaaaggccagggtgtccgtgagggcgagatgtgagaccgcaacaatgaatgatggatgccaatggaggaagtacggtcagaaaaccgcgaaagggaatccatgtcctcgagcttattaccgatgcaccgtggctccaggatgtcccgttagaaaacaggtgcaaaggtgtttagaagacatgtcaatactgataacaacctacgaaggaacacataaccatccacttccggtcggagcaacagccatggcttccactgcctctacttctccattcttgttactcgattccagtgacaacctctctcatccttcctattaccaaactcctcaagccatagactcttctttgattacatacccacaaaatagcagctacaacaatcgaaccataagaagcttgaactttgatggtccatctagaggagatcacgtttcatcttctcaaaaccgattaaattggatgatgtagagtttcctatatctctatgcttgttctttggtcccattatttgtcattatggattctttgcctttcttcttgttctcgtttctaacatttatgtttcgtata

SEQ ID NO: 980 - protein, 348 aa, Arabidopsis thaliana
MGIDLSLKLEAEEKKKEIEGSKHSRENKEDEEHDASGDEDEQMVKEDEDDSSSLGLRTREEENEREELLQLQIQMESVKEENTRLRKLVEQTLEDYRHLEMKFPVIDKTKKMDLEMFLGVQGKRCVDITSKARKRGAERSPSMEREIGLSLSLEKKQKQEESKEAVQSHHQRYNSSSLDMNMPRIISSSQGNRKARVSVRARCETATMNDGCQWRKYGQKTAKGNPCPRAYYRCTVAPGCPVRKQVQRCLEDMSILITTYEGTHNHPLPVGATAMASTASTSPFLLLDSSDNLSHPSYYQTPQAIDSSLITYPQNSSYNNRTIRSLNFDGPSRGDHVSSSQNRLNWMM

SEQ ID NO: 981 - DNA, 1311 bp, Arabidopsis thaliana
atgggtgaggagttagctgacacaatgaacctggatttgaatcttgggcctggtcctgagtctgatctccaacctgcaccaaacgagactgtgaatttggctgattggactaatgacccgcctgagagatcttctgaagctgtgacaaggatcaggactcggcataggacacggttcagacagcttaatctcccgatcccggttctatctgaaacccataccatggctatagagctcaaccagttgatgggaaattctgtaaatagagctgctatgcagactggtgagggtagtgaaagaggcaatgaggatttgaaaatgtgtgagaatggcgatggagcccttggggacggtgtattggataagaaagcggatgtcgagaaaagcagtggcagcgacggtaactttttcgattgtaatatatgtttggatttgtcgaaggagccggttctcacctgttgtggtcatctttactgttggccttgtctgtaccaatggttacaaatttcggatgcaaaggaatgtcctgtttgtaaaggagaggtgacctccaaaaccgtgacaccgatctatggacgtggaaaccacaagagagaaattgaagagagtttagatactaaggtccccatgagaccacacgcgagacgcattgagagcttgaggaatacaattcaaaggtcgccttttacaataccaatggaagaaatgattagacgtatacagaataggtttgacagggattcaaccccagtccctgattttagtaaccgagaggcatcagaaagagtcaacgatcgagccaattcgatccttaaccggttgatgacatctaggggagttagatcagagcagaaccaggctagtgctgcagcagcagccattgtcgcagcatcagaggatattgatctaaatccaaacattgctcctgatcttgaaggagaaagcaacacgagattccatcctctcttgatcaggagacagttacagtcgcaccgagttgcaaggatctcgactttcacttctgcgttgagttcagctgagaggcttgtggatgcgtattttaggactcatccgttggggaggaaccaccaagagcaaaaccatcatgctcctgttgtggttgatgatagagactcattctcaagcattgcagctgttataaactctgagagtcaagtggatactgcagttgagatcgattctatggctctttcgacatcgtcctcgaggagaaggaatgagaatggttcgagggtttctgatgtagacagtgcagattctcgtccgcctaggagaaggagatttacttga

SEQ ID NO: 982 - protein, 436 aa, Arabidopsis thaliana
MGEELADTMNLDLNLGPGPESDLQPAPNETVNLADWTNDPPERSSEAVTRIRTRHRTRFRQLNLPIPVLSETHTMAIELNQLMGNSVNRAAMQTGEGSERGNEDLKMCENGDGALGDGVLDKKADVEKSSGSDGNFFDCNICLDLSKEPVLTCCGHLYCWPCLYQWLQISDAKECPVCKGEVTSKTVTPIYGRGNHKREIEESLDTKVPMRPHARRIESLRNTIQRSPFTIPMEEMIRRIQNRFDRDSTPVPDFSNREASERVNDRANSILNRLMTSRGVRSEQNQASAAAAAIVAASEDIDLNPNIAPDLEGESNTRFHPLLIRRQLQSHRVARISTFTSALSSAERLVDAYFRTHPLGRNHQEQNHHAPVVVDDRDSFSSIAAVINSESQVDTAVEIDSMALSTSSSRRRNENGSRVSDVDSADSRPPRRRRFT

SEQ ID NO: 983 - DNA, 866 bp, Arabidopsis thaliana
gtgtttgtagttgaaacttattcttccctttttttgtttttaggtatggagactctgcatccattctctcacctacctatctctgaccaccggttcgttgttcaagagatggtgagcttacacagctcgagtagcggtagctggactaaagaagagaacaagatgttcgaacgagctcttgcgatatacgctgaagactcgcctgatcgctggtttaaagttgcttccatgatccctggaaagactgtttttgatgttatgaagcaatatagtaagcttgaagaagacgttttcgatattgaagcaggacgtgttcccattcctggttatcctgcagcttcttctcccttggggtttgacacggacatgtgtcgtaaacggcctagtggagctagaggatctgatcaagatcgaaagaaaggagtcccttggacagaggaagaacacaggagattcttgttaggccttctcaagtacggtaaaggagattggagaaacatatcgagaaacttcgtggtgtcaaagacgccaacgcaagtggcgagccacgcccaaaagtattaccagagacagctctccggagccaaggacaaacgcaggccaagtatccatgacatcacaaccggcaatcttctcaatgccaatctcaaccgttccttttccgatcatagagatattctccctgatttagggtttatcgataaggatgatacggaggagggagtaatatttatgggtcagaatctctcttcagaaaatctgttttctccatcaccaacttcattcgaagctgccattaacttcgccggagaaaatgtcttcagtgccggagcttaaggcaacatagaatccccaaactcagcggc

SEQ ID NO: 984 - protein, 263 aa, Arabidopsis thaliana
METLHPFSHLPISDHRFVVQEMVSLHSSSSGSWTKEENKMFERALAIYAEDSPDRWFKVASMIPGKTVFDVMKQYSKLEEDVFDIEAGRVPIPGYPAASSPLGFDTDMCRKRPSGARGSDQDRKKGVPWTEEEHRRFLLGLLKYGKGDWRNISRNFVVSKTPTQVASHAQKYYQRQLSGAKDKRRPSIHDITTGNLLNANLNRSFSDHRDILPDLGFIDKDDTEEGVIFMGQNLSSENLFSPSPTSFEAAINFAGENVFSAGA

SEQ ID NO: 985 - DNA, 639 bp, Arabidopsis thaliana
atggaagagaacaacggcaacaacaaccactacctgccgcaaccatcgtcttcccaactgccgccgccaccattgtattatcaatcaatgccgttgccgtcatattcactgccgctgccgtactcaccgcagatgcggaattattggattgcgcagatgggaaacgcaactgatgttaagcatcatgcgtttccactaaccaggataaagaaaatcatgaagtccaacccggaagtgaacatggtcactgcagaggctccggtccttatatcgaaggcctgtgagatgctcattcttgatctcacaatgcgatcgtggcttcataccgtggagggcggtcgccaaactctcaagagatccgatacgctcacgagatccgatatctccgccgcaacgactcgtagtttcaaatttaccttccttggcgacgttgtcccaagagacccttccgtcgttaccgatgatcccgtgctacatccggacggtgaagtacttcctccgggaacggtgataggatatccggtgtttgattgtaatggtgtgtacgcgtcaccgccacagatgcaggagtggccggcggtgcctggtgacggagaggaggcagctggggaaattggaggaagcagcggcggtaattga

SEQ ID NO: 986 - protein, 212 aa, Arabidopsis thaliana
MEENNGNNNHYLPQPSSSQLPPPPLYYQSMPLPSYSLPLPYSPQMRNYWIAQMGNATDVKHHAFPLTRIKKIMKSNPEVNMVTAEAPVLISKACEMLILDLTMRSWLHTVEGGRQTLKRSDTLTRSDISAATTRSFKFTFLGDVVPRDPSVVTDDPVLHPDGEVLPPGTVIGYPVFDCNGVYASPPQMQEWPAVPGDGEEAAGEIGGSSGGN

SEQ ID NO: 987 - DNA, 1625 bp, Arabidopsis thaliana
tcttccgtgtgttaacagaagtccccacaattgtctgtcttcgctgcgagacaaaactgccacagccaataatgtttctctgagggaccttgcttctgtcagagactcgctctctctctcctcttcttgctctgctcagctctctcaccaactcatcttcagtcctcaaacaaacatctgttctcatctttgttttctttcctttctttctcatatctcattttcaattttcccaatttctcttcaacatcttcatagcaatttaagaccactattccattataaagctaactgctttagaaactcctcacatttatttcttccccatcattgttttagagagggagaaagaaaaagagctcagctttctgatggagaggagtattcaaggacaaaacaagctctgttgtttggaccaaaaagtgaatgtgagaagaagcctacaagttcaagaaactgtagaggatcatcaaagctttgcccttgaagaggaagaacaacaactctcaactccgagcttgctgcaagacacaacaataccatttctacaaatgctgcaacaaagtgaagacccttcaccgtttttgtcattcaaagacccaagctttctagcactactatctctccagacacttgaaaagccttgggaactcgaaaactacctcccacatgaagttccagagtttcattcaccgatccattctgaaaccaaccactactatcataatccatctttggaaggagtcaatgaagccatctcaaaccaagaacttccattcaacccactagagaatgcgcgttcaagacgcaagcggaaaaacaacaacttggcatcattgatgacaagagaaaagcgaaagagaagaagaactaaaccaacaaagaacatagaagagatagagagtcaaagaatgacacacattgcggttgaacgaaaccgcagacgccaaatgaacgttcatctgaactcactccgctccatcattccatcttcatacatccagaggggagaccaagcgtcaatagtaggaggagcaatagacttcgtaaagatcctagagcaacagttgcaatcccttgaagcacaaaagagaagtcaacagagtgatgataacaaagagcaaattccagaagataacagtctcaggaacatttcgtcgaacaagttgcgtgcgagtaataaagaagaacaaagtagcaaactcaaaatcgaagccacagtgatagagagtcacgtcaacctaaaaattcaatgtacgaggaaacaaggacaacttctcagatcaatcatattgctggagaaacttcgattcactgttcttcatctcaacatcacatctccgaccaatacatctgtctcttattccttcaacctcaagatggaagatgaatgtaatttgggatcagcggatgagataacggcggcgattcgtcagattttcgacagctgattgactaatccaagtaaaaagtaaaataaaaaaagaaacgtttactttggtaacttcgttttcatgattaaattctttatttggtcgtatgtgattggagtcttctcggcatggaacttgactttggttttagggtactagtctctacagaagctgtggtccttctttggatgc

SEQ ID NO: 988 - protein, 359 aa, Arabidopsis thaliana
MERSIQGQNKLCCLDQKVNVRRSLQVQETVEDHQSFALEEEEQQLSTPSLLQDTTIPFLQMLQQSEDPSPFLSFKDPSFLALLSLQTLEKPWELENYLPHEVPEFHSPIHSETNHYYHNPSLEGVNEAISNQELPFNPLENARSRRKRKNNNLASLMTREKRKRRRTKPTKNIEEIESQRMTHIAVERNRRRQMNVHLNSLRSIIPSSYIQRGDQASIVGGAIDFVKILEQQLQSLEAQKRSQQSDDNKEQIPEDNSLRNISSNKLRASNKEEQSSKLKIEATVIESHVNLKIQCTRKQGQLLRSIILLEKLRFTVLHLNITSPTNTSVSYSFNLKMEDECNLGSADEITAAIRQIFDS

SEQ ID NO: 989 - DNA, 1409 bp, Arabidopsis thaliana
cataccggtggaagattctgctttactacgctctccgcttcttcttctcctcgattcgattctcctcatgggtttatcatgaatttttaggttttgagtaattcagaaactcgagtgatgatcccgaatgatgatgatgatgcaaattctatgaagaattatccgttaaatgatgatgatgcaaattctatgaagaattatccgttaaatgatgatgatgcaaattctatggagaattatccgttaaggtcaattccgacggagctttcacacacttgttcattgataccaccttctttaccaaacccttcagaagcagcagcagacatgtccttcaattcagaactcaatcaaatcatggcaaggccttgtgatatgctccctgccaatggtggagctgttggtcataacccttttttggaaccaggattcaactgccccgagacaacagattggattccctctccactcccccatatttattttccttcgggttctcccaatctaataatggaggatggtgtcattgatgagattcacaaacaaagtgacttgccactttggtatgacgacttgattaccactgatgaagatccactcatgtctagtatcttgggcgatcttctccttgacactaatttcaactcagcttcaaaggtccagcaaccaagtatgcaatcgcagattcaacaaccccaagctgttctgcagcagccttcttcttgtgtggaattgcgcccacttgataggacagtatcctcaaacagcaacaacaatagcaacagtaataatgcagcagcagcagctaagggacgtatgcgttggacgcctgaacttcatgaggtttttgttgacgctgttaaccagctcggtggcagtaatgaagcaactcctaaaggtgtcctgaagcatatgaaagtcgaaggtttgactatttttcatgtcaaaagtcatttgcagaaatatagaacagctaaatatataccagtaccatcagaaggttcgccggaggcaaggttgacaccgcttgagcaaattacatctgatgatacgaaacgtgggatagatatcactgagactctgcgaattcagatggaacatcagaagaaactgcatgagcagcttgagagtctaagaacaatgcaacttcggatagaagagcaaggaaaggcgctgttgatgatgattgagaagcaaaatatgggtttcggcggaccagaacaaggagagaaaacaagtgcgaaaacgcctgaaaatggttcagaggagtcggaatccccgcggccaaagcgtccgagaaatgaagaatgaaggaaacctttcttcggatggtagatcataaaactgtggttttggtggagttgtagagtatgacttattaggagtagagctttcagtcttcttcaggc

SEQ ID NO: 990 - protein, 397 aa, Arabidopsis thaliana
MIPNDDDDANSMKNYPLNDDDANSMKNYPLNDDDANSMENYPLRSIPTELSHTCSLIPPSLPNPSEAAADMSFNSELNQIMARPCDMLPANGGAVGHNPFLEPGFNCPETTDWIPSPLPHIYFPSGSPNLIMEDGVIDEIHKQSDLPLWYDDLITTDEDPLMSSILGDLLLDTNFNSASKVQQPSMQSQIQQPQAVLQQPSSCVELRPLDRTVSSNSNNNSNSNNAAAAAKGRMRWTPELHEVFVDAVNQLGGSNEATPKGVLKHMKVEGLTIFHVKSHLQKYRTAKYIPVPSEGSPEARLTPLEQITSDDTKRGIDITETLRIQMEHQKKLHEQLESLRTMQLRIEEQGKALLMMIEKQNMGFGGPEQGEKTSAKTPENGSEESESPRPKRPRNEE

SEQ ID NO: 991 - DNA, 1148 bp, Arabidopsis thaliana
ttcatctccatcattatctccattgacattgttctcaattgcgaataataatcataattattcacacaaccaaagcattcatctctcagattctcttaaaaaaatggagaaatcagatcctccaccagtcccaaagcccggcgccactattatcccctcctccgatccaattcctaatgccgatccgattccatcttcttccttccaccgccgatctcgctccgacgatatgtccatgttcatgttcatggatcccctctcctccgccgcaccaccttcctccgacgaccttccctccgacgacgatctcttctcttctttcatcgatgtcgatagcctcacctctaatcccaatccctttcaaaatccttccctctcctccaactccgtttccggcgctgctaatcctcctcctcctccttcctctcgtcctcgccaccgtcacagcaattccgttgacgctggatgcgccatgtatgccggtgatatcatggacgctaagaaagctatgcctcctgaaaaactctctgagctttggaacatcgatcccaaacgcgccaaaaggattctagcgaatcgacaatctgcagctcgatccaaagagagaaaagctcgatacattcaagaacttgagcgcaaagttcaatctcttcaaaccgaagctaccactctctctgctcagcttactctctaccagagagacacaaatggactagcaaacgaaaacacagagctgaaacttaggttgcaagcaatggaacaacaagctcagcttcgtaatgctttaaacgaagcgttgaggaaagaagttgaaaggatgaagatggagacaggagaaatctctggtaattcagattcgtttgatatgggaatgcagcagattcagtattcttcctcaactttcatggctattccaccatatcatggctcaatgaacctccatgatatgcagatgcattctagtttcaatcctatggagatgtccaattctcaaagcgtgtcggactttctacagaacggccgaatgcaagggctggagattagtagcaatagctcaagcttagtcaaatctgaaggaccttctctctctgctagtgagagtagctctgcctattgacgacaagattatgatgaggctcatttttctg

SEQ ID NO: 992 - protein, 337 aa, Arabidopsis thaliana
MEKSDPPPVPKPGATIIPSSDPIPNADPIPSSSFHRRSRSDDMSMFMFMDPLSSAAPPSSDDLPSDDDLFSSFIDVDSLTSNPNPFQNPSLSSNSVSGAANPPPPPSSRPRHRHSNSVDAGCAMYAGDIMDAKKAMPPEKLSELWNIDPKRAKRILANRQSAARSKERKARYIQELERKVQSLQTEATTLSAQLTLYQRDTNGLANENTELKLRLQAMEQQAQLRNALNEALRKEVERMKMETGEISGNSDSFDMGMQQIQYSSSTFMAIPPYHGSMNLHDMQMHSSFNPMEMSNSQSVSDFLQNGRMQGLEISSNSSSLVKSEGPSLSASESSSAY

SEQ ID NO: 993 - DNA, 948 bp, Arabidopsis thaliana
atgatgatcggcgaaaataaaaaccggccacatccaacgatccatatccctcaatgggatcaaatcaacgatccaacggccacaatctcttcaccattctcttccgtcaaccttaacagcgttaacgactacccacactctccgtcaccgtatctcgactccttcgcttctctcttccgttacctcccgtcaaacgagttaacaaacgattcagactcatcaagtggcgacgagtcatcaccactcaccgactcattctcctccgacgagtttcgcatctacgagttcaaaatccggcgatgcgctcgaggtcgatctcatgattggacggagtgtccgttcgcacatcccggagaaaaagctcgacgacgtgatccgagaaagtttcattactccggcaccgcttgtcctgagtttcgtaaaggaagttgtagaagaggtgattcgtgtgagttctctcatggagttttcgagtgttggctccatccttctcgttaccgtactcagccgtgtaaagacggaactagctgccggagaagaatctgtttcttcgctcatacgacggagcagttacgtgtattaccttgttcgttagatccagatcttggattcttctcaggattagctacttctccgacttcgattcttgtttctccttcgttttcaccaccgtcggaatctccgccgctttctccgagtaccggtgaacttattgcgtcgatgaggaaaatgcaattgaacggaggtggttgttcgtggagttctccgatgagatctgcagttaggttacctttttcgtcgtctctgcgtccgattcaggcggcaacgtggccgaggataagagagtttgagatcgaagaagctccggcgatggaatttgtggaatctgggaaagagctgagagcggagatgtatgcaagactcagtagagagaactcactcggttga

SEQ ID NO: 994 - protein, 315 aa, Arabidopsis thaliana
MMIGENKNRPHPTIHIPQWDQINDPTATISSPFSSVNLNSVNDYPHSPSPYLDSFASLFRYLPSNELTNDSDSSSGDESSPLTDSFSSDEFRIYEFKIRRCARGRSHDWTECPFAHPGEKARRRDPRKFHYSGTACPEFRKGSCRRGDSCEFSHGVFECWLHPSRYRTQPCKDGTSCRRRICFFAHTTEQLRVLPCSLDPDLGFFSGLATSPTSILVSPSFSPPSESPPLSPSTGELIASMRKMQLNGGGCSWSSPMRSAVRLPFSSSLRPIQAATWPRIREFEIEEAPAMEFVESGKELRAEMYARLSRENSLG

SEQ ID NO: 995 - DNA, 1430 bp, Arabidopsis thaliana
aaaaaaaaagttgatatactttctggttttctccttaacttttattctttacaaatccatcccccttagatctgtttatttcccgctactttgattcatttctgttagtaatctgtctttcgtatagaagaaaactgatttcttggtttgtattttcttaaagagatcaatctttttttatttttgatcttcttgtgtttttttttctttgtagaattaatcgtttgtgagggtatttttttaattccctcctctcagaaatctacacagaggttttttattttataaacctctttttcgattttcttgaaaacaaaaaatcctgttctttactttttttacaagaacaagggaaaaaaatttctttttattagaaatgacaacttctatggatttttacagtaacaaaacgtttcaacaatctgatccattcggtggtgaattaatggaagcgcttttaccttttatcaaaagcccttccaacgattcatccgcgtttgcgttctctctacccgctccaatttcatacgggtcggatctccactcattttctcaccatcttagtcctaaaccggtctcaatgaaacaaaccggtacttccgcggctaaaccgacgaagctatacagaggagtgagacaacgtcactggggaaaatgggtggctgagattcgtttaccgaggaatcgaactcgactttggctcggaacattcgacacggcggaggaagctgctttagcttatgacaaggcggcgtataagctccgaggagattttgcgcggcttaatttccctgatctccgtcataacgacgagtatcaacctcttcaatcatcagtcgacgctaagcttgaagctatttgtcaaaacttagctgagacgacgcagaaacaggtgagatcaacgaagaagtcttcttctcggaaacgttcatcaaccgtcgcagtgaaactaccggaggaggactactctagcgccggatcttcgccgctgttaacggagagttatggatctggtggatcttcttcgccgttgtcggagctgacgtttggtgatacggaggaggagattcagccgccgtggaacgagaacgcgttggagaagtatccgtcgtacgagatcgattgggattcgattcttcagtgttcgagtcttgtaaattagatgttgccataggggtattttagggactttagagctctctgcgatggagtttttggtcattgcagagattttattattattaagggggtttgttatgttaatatcaaataagtttatctactttgatgttaattagtgttaatctctgcgtcggtccaagctgtttttttttggcatgcttcgaccgtgtgagatttcttatgtaatttttgtagttccttgattttcttagttcaagttaaattggcacaaaaaaaaaaaaaaaaaa

SEQ ID NO: 996 - protein, 261 aa, Arabidopsis thaliana
MTTSMDFYSNKTFQQSDPFGGELMEALLPFIKSPSNDSSAFAFSLPAPISYGSDLHSFSHHLSPKPVSMKQTGTSAAKPTKLYRGVRQRHWGKWVAEIRLPRNRTRLWLGTFDTAEEAALAYDKAAYKLRGDFARLNFPDLRHNDEYQPLQSSVDAKLEAICQNLAETTQKQVRSTKKSSSRKRSSTVAVKLPEEDYSSAGSSPLLTESYGSGGSSSPLSELTFGDTEEEIQPPWNENALEKYPSYEIDWDSILQCSSLVN

SEQ ID NO: 997 - DNA, 820 bp, Arabidopsis thaliana
gaagactccaacataattcatcatctatggcttcttcacatcaacaacagcaagaacaagaccagtcagctttagatctcataacccaacaccttcttactgatttcccttccttagacacctttgcctccaccatccaccactgcaccacctcaactctaagccaacgcaaaccacctcttgccactatagcagttcctactactgcaccggtggttcaagagaatgatcaaaggcattacagaggcgtcaggagaagaccatggggtaagtatgcggctgagatcagagacccaaacaagaaaggtgttcgtgtctggttaggcacttttgacacagccatggaagctgcaagaggttatgacaaggcagcttttaaactacgaggaagcaaagctattcttaacttcccacttgaagcaggaaagcatgaggacttgggagacaacaagaagactatttctttaaaagcaaagaggaagagacaggtgacggaggatgaaagccagctgatcagccgtaaagctgttaagagggaagaagctcaggttcaggctgatgcttgtccattaacgccatcaagttggaaggggttttgggacggagcagacagtaaagacatgggaatattttccgtgcctctgttatctccttgtccatctcttggacactctcaactcgtagttacttaagcttcagagggtcaaactggaaaaaatcaacattggattgttttcaaagcttctagattagctgattgtaaaaaaatgttttactatattcattcattcttcttaaatgcaattctttctacccttcc

SEQ ID NO: 998 - protein, 221 aa, Arabidopsis thaliana
MASSHQQQQEQDQSALDLITQHLLTDFPSLDTFASTIHHCTTSTLSQRKPPLATIAVPTTAPVVQENDQRHYRGVRRRPWGKYAAEIRDPNKKGVRVWLGTFDTAMEAARGYDKAAFKLRGSKAILNFPLEAGKHEDLGDNKKTISLKAKRKRQVTEDESQLISRKAVKREEAQVQADACPLTPSSWKGFWDGADSKDMGIFSVPLLSPCPSLGHSQLVVT

SEQ ID NO: 999 - DNA, 896 bp, Arabidopsis thaliana
ttatctcgtagcctttaaacgatggagactctgcatccactactctcgcacgtgccaacttctgaccaccggtttgtagttcaagagatgatgtgcttgcaaagctcgagctggactaaagaagagaacaagaagtttgagcgagctcttgctgtctacgctgatgacacgcctgatcgctggttcaaagttgctgctatgatccctggaaagaccatatcagatgtcatgaggcaatactctaagcttgaagaagacctcttcgatatcgaagcaggacttgtcccgatcccgggttaccgttcagttactccttgtggatttgatcaggttgtgagtccacgtgactttgatgcgtatcgtaaacttcctaatggagccagaggatttgatcaagaccgtaggaaaggagttccatggacggaggaagaacacaggagattcttgttagggcttctcaagtatgggaaaggagattggagaaacatatcgaggaactttgtgggatcaaaaacaccaactcaggttgcaagtcatgcccaaaagtactaccaaagacagctttccggtgcgaaagacaaacgacggcctagcattcacgacatcaccaccgtcaatcttctcaatgccaatcttagccgtccatcgtctgatcacggttgcttagtctcaaaacaggccgagccgaaactagggttcaccgacagggataatgcagaggagggagttatgtttcttggtcagaatctatcctcggtcttctcttcctacgatcctgccattaagttttccggagcaaatgtttacggtgaaggaggttactgtatctcacaagatcttgaaacgagaaaatgagaattttgaaattttaactattgcaacgaaaccataattgc

SEQ ID NO: 1000 - protein, 277 aa, Arabidopsis thaliana
METLHPLLSHVPTSDHRFVVQEMMCLQSSSWTKEENKKFERALAVYADDTPDRWFKVAAMIPGKTISDVMRQYSKLEEDLFDIEAGLVPIPGYRSVTPCGFDQVVSPRDFDAYRKLPNGARGFDQDRRKGVPWTEEEHRRFLLGLLKYGKGDWRNISRNFVGSKTPTQVASHAQKYYQRQLSGAKDKRRPSIHDITTVNLLNANLSRPSSDHGCLVSKQAEPKLGFTDRDNAEEGVMFLGQNLSSVFSSYDPAIKFSGANVYGEGGYCISQDLETRK

SEQ ID NO: 1001 - DNA, 954 bp, Arabidopsis thaliana
atggtgaaggagacggtgacggtggcgaaaacgtgctcacactgtggccataatggccataacgcacggacttgtctcaacggcgttaataaggcaagtgttaaactgttcggcgttaatatatcgtctgatccgattaggccgcctgaggtaacggcgttaaggaagagtcttagtttgggaaaccttgatgctcttctcgctaacgatgaaagtaacggtagcggtgatcctatcgccgccgttgatgataccggttatcattccgatggtcagattcattccaagaagggtaaaactgctcatgagaagaaaaaggggaagccatggacggaagaagaacatcgtaatttcttaatcggtttaaacaaactcggaaaaggagattggagaggcattgcaaagagtttcgtgtcgacaagaacaccaacacaagtcgcaagtcatgctcagaaatattttattaggttaaacgttaacgacaagagaaaaagacgtgctagtctctttgacatctctctcgaagatcagaaggagaaagagaggaactctcaagatgcttcaacaaagactccacctaaacaaccaataaccggaattcaacaaccggtagtacaaggtcatactcaaaccgagatttcgaacaggtttcagaatttatcaatggagtatatgccaatctaccaacccataccaccttactacaactttccacctattatgtaccatccaaattatccaatgtactatgccaaccctcaagtaccggttaggtttgttcatccttctggtatacctgttccaagacatataccgattggtttgcctctgtctcaaccgagtgaagcttctaatatgacaaataaagacggtttggatcttcatatcggtttgcctccacaagctactggagcttctgacttgactggtcatggcgttattcatgtgaaatga

SEQ ID NO: 1002 - protein, 317 aa, Arabidopsis thaliana
MVKETVTVAKTCSHCGHNGHNARTCLNGVNKASVKLFGVNISSDPIRPPEVTALRKSLSLGNLDALLANDESNGSGDPIAAVDDTGYHSDGQIHSKKGKTAHEKKKGKPWTEEEHRNFLIGLNKLGKGDWRGIAKSFVSTRTPTQVASHAQKYFIRLNVNDKRKRRASLFDISLEDQKEKERNSQDASTKTPPKQPITGIQQPVVQGHTQTEISNRFQNLSMEYMPIYQPIPPYYNFPPIMYHPNYPMYYANPQVPVRFVHPSGIPVPRHIPIGLPLSQPSEASNMTNKDGLDLHIGLPPQATGASDLTGHGVIHVK

SEQ ID NO: 1003 - DNA, 1740 bp, Arabidopsis thaliana
taacaaatcaaataattagagaaataaccaaaatttaacttttagagggactacaggatttgtactttgtacattcatatattattgttatatatcgtttcatacattaatttgaaccaatgtaaattaagtaaaattcaatttaacatcatgagcaaattcttattaaaattctcttaaaattttgagcaaattatgctttcacatttaacatttgaaaacatcatttttaacaagatattcaaaactaagttttgtacagcaaaattttaactttcaattttatagagaaaaaggtatttttttttttgtttcatttttataagactattatttggtatataatatacactttaagtaaaaacaaatctctttcttttttcttcttataataccaaccacaagtctgtcagtcacacacatacagttaataacattaaatattcttaacaaactactaaataggttgagattcatatatgtaaagagatcacttcttaatcttatcctaccatatcttatatacgcttaattttcctttatatatgcaaacctccacataaaaatatctcaaacccaaacacttcaaacaaaaaaaaaatggagaacaacaacaacaaccaccaacagccaccgaaagataacgagcaactaaagagtttctggtcaaaggggatggaaggtgacttgaatgtcaagaatcacgagttccccatctctcgtatcaagaggataatgaagtttgatccggatgtgagtatgatcgctgctgaggctccaaatctcttatctaaggcttgtgaaatgtttgtcatggacctcacgatgcgttcatggctccatgctcaagagagcaaccgactcacgatacggaaatctgatgttgatgccgtagtgtctcaaaccgtcatctttgatttcttgcgtgatgatgtccctaaggacgagggagagcccgttgtcgccgctgctgatcctgtggacgatgttgctgatcatgtggctgtgccagatcttaacaatgaagaactgccgccgggaacggtgataggaactccggtttgttacggtttaggaatacacgcgccacacccgcagatgcctggagcttggaccgaggaggatgcgactggggcaaatggaggaaacggtgggaattaatatttggattgggttttgtaaccgctgttgtgagaacttgaatttctttttgagttctgcttatgttttcaatgttatgttttttagttgttgaatgtatttctgttgttttgtccaaaaaaaaaaaagaatgtatttctgttgttgtctttcaaatgaatctaatggtttatgaatattggctttagattaatttatgcatacaaaaacacaaggattacggataaaaaagtcctcagtttacccatggaaacataatcttctagtgattccttatgagagtagaaaagaatcatatattataatctatttcataagagatagggtactgtaaacaaggatgtttattcggctatttcttttttttttaatcacttttacttgtcaagactcttttgtgtttgcagctttttgttagattacattctagaggcaacaagatccagagatctagcaaaaaaaacttattttgaaacctgaatctattttaaaaattttccaactcatttttcgttcttattctttgttttccaacggaatttggcgcacaaacgatttatttgaattttgtctttcaag

SEQ ID NO: 1004 - protein, 186 aa, Arabidopsis thaliana
MENNNNNHQQPPKDNEQLKSFWSKGMEGDLNVKNHEFPISRIKRIMKFDPDVSMIAAEAPNLLSKACEMFVMDLTMRSWLHAQESNRLTIRKSDVDAVVSQTVIFDFLRDDVPKDEGEPVVAAADPVDDVADHVAVPDLNNEELPPGTVIGTPVCYGLGIHAPHPQMPGAWTEEDATGANGGNGGN

SEQ ID NO: 1005 - DNA, 609 bp, Arabidopsis thaliana
atggctgagaacaacaacaacaacggcgacaacatgaacaacgacaaccaccagcaaccaccgtcgtactcgcagctgccgccgatggcatcatccaaccctcagttacgtaattactggattgagcagatggaaaccgtctcggatttcaaaaaccgtcagcttccattggctcgaattaagaagatcatgaaggctgatccagatgtgcacatggtctccgcagaggctccgatcatcttcgcaaaggcttgcgaaatgttcatcgttgatctcacgatgcggtcgtggctcaaagccgaggagaacaaacgccacacgcttcagaaatcggatatctccaacgcagtggctagctctttcacctacgatttccttcttgatgttgtccctaaggacgagtctatcgccaccgctgatcctggctttgtggctatgccacatcctgacggtggaggagtaccgcaatattattatccaccgggagtggtgatgggaactcctatggttggtagtggaatgtacgcgccatcgcaggcgtggccagcagcggctggtgacggggaggatgatgctgaggataatggaggaaacggcggcggaaattga

SEQ ID NO: 1006 - protein, 202 aa, Arabidopsis thaliana
MAENNNNNGDNMNNDNHQQPPSYSQLPPMASSNPQLRNYWIEQMETVSDFKNRQLPLARIKKIMKADPDVHMVSAEAPIIFAKACEMFIVDLTMRSWLKAEENKRHTLQKSDISNAVASSFTYDFLLDVVPKDESIATADPGFVAMPHPDGGGVPQYYYPPGVVMGTPMVGSGMYAPSQAWPAAAGDGEDDAEDNGGNGGGN

SEQ ID NO: 1007 - DNA, 1200 bp, Arabidopsis thaliana
atgtctaaatctagagatacggagataaagttgtttgggaggacaatcacatctcttttagatgtgaattgttatgatccgtcgtcgttgtcccctgttcacgatgtttcttctgatccaagcaaggaggattcgtcttcttcttcatcttcttgttctccaactattggaccaatcagggttccggttaaaaaaagtgagcaagagagtaacaaattcaaagatccatatatattatccgatctaaacgaaccaccaaaagcagtatctgagatttcatcaccaagaagttccaagaacaactgtgatcaacagagcgagatcacaacaacaactaccacaagtactacatcaggagagaaatcaacggctctcaagaaaccggacaagcttattccatgtcctagatgtgaaagcgcaaacaccaaattctgttattacaacaactacaacgtgaaccagccacgttacttctgcaggaactgtcagaggtattggacagctggtggatctatgaggaacgttcctgttggctcaggtcgtcgcaagaacaaaggatggccttcttcaaaccattacttgcaagtcacttctgaggattgtgataataataactcggggacgatccttagtttcggttcttcggagtcttcggttacagagactggtaagcatcagtcaggtgatacagcaaagataagtgctgattcagtttctcaagaaaataaaagctaccaagggtttcttcctccgcaagtaatgttacctaataattcttctccttggccttaccaatggagtccaacgggtcctaacgctagtttctaccctgtccccttctactggggatgcacggttccgatataccctacctcagagacttcatcatgtttaggaaaacggtcaagagatcaaactgaaggaagaatcaatgatactaatacaacaataactactacaagagcaagattggtctcagaatctcttagaatgaatatcgaagctagtaagagcgctgtgtggtctaagttaccgacaaaacccgagaaaaaaacgcaaggattcagtttgttcaatggatttgacacaaagggaaacagcaacagaagtagcttggtctccgaaacttctcacagtctacaagcaaaccctgcagcgatgtctagagctatgaacttcagggagagcatgcaacaataa

SEQ ID NO: 1008 - protein, 399 aa, Arabidopsis thaliana
MSKSRDTEIKLFGRTITSLLDVNCYDPSSLSPVHDVSSDPSKEDSSSSSSSCSPTIGPIRVPVKKSEQESNKFKDPYILSDLNEPPKAVSEISSPRSSKNNCDQQSEITTTTTTSTTSGEKSTALKKPDKLIPCPRCESANTKFCYYNNYNVNQPRYFCRNCQRYWTAGGSMRNVPVGSGRRKNKGWPSSNHYLQVTSEDCDNNNSGTILSFGSSESSVTETGKHQSGDTAKISADSVSQENKSYQGFLPPQVMLPNNSSPWPYQWSPTGPNASFYPVPFYWGCTVPIYPTSETSSCLGKRSRDQTEGRINDTNTTITTTRARLVSESLRMNIEASKSAVWSKLPTKPEKKTQGFSLFNGFDTKGNSNRSSLVSETSHSLQANPAAMSRAMNFRESMQQ

SEQ ID NO: 1009 - DNA, 582 bp, Arabidopsis thaliana
atggagattgagaaggatgaggacgacacaacattggttgattctggaggagacttcgactgcaacatatgtttggatcaggttcgagacccggtcgtgactttatgtggccacctgttttgttggccctgcattcacaagtggacttatgcgtccaacaattcaagacaacgagtcgatcaatacgatcataagagggaaccaccaaaatgtccggtatgcaaatctgatgtctccgaggctacgcttgtcccgatctacggacgaggacagaaagctccccagtccggttcaaatgtaccgagcagaccaactggtccggtttatgacttaagaggagttggtcaacgtttaggagaaggggagagtcaacgttacatgtatagaatgcctgatccggtgatgggtgtggtatgcgaaatggtataccggagactatttggagagtcttcgagcaacatggcaccttaccgcgatatgaatgtccggtctaggcgacgggcaatgcaggctgaggagtcattaagcagagtctacttgtttctactttgcttcatgtttatgtgtctatttctcttctaa

SEQ ID NO: 1010 - protein, 193 aa, Arabidopsis thaliana
MEIEKDEDDTTLVDSGGDFDCNICLDQVRDPVVTLCGHLFCWPCIHKWTYASNNSRQRVDQYDHKREPPKCPVCKSDVSEATLVPIYGRGQKAPQSGSNVPSRPTGPVYDLRGVGQRLGEGESQRYMYRMPDPVMGVVCEMVYRRLFGESSSNMAPYRDMNVRSRRRAMQAEESLSRVYLFLLCFMFMCLFLF

SEQ ID NO: 1011 - DNA, 1538 bp, Arabidopsis thaliana
aaaattctcctgtaaaatttaatattataaaagtggtttctttttcatttatgtttatataattttcatctttaatcttaaattctggtaaccttaatgcgcgatccgcttttctaaagttttgtgagagagaagagatctaaaaaaatccacaattttgttcaaatcttggagttaaatgctgaattttaggccttgttgcttagatttatggcttaaagtttcaaacttttcattggatatgtgagaagaaaatgtcaggatctgagacgggtttaatggcggcgaccagagaatcaatgcaatttacaatggctctccaccagcagcagcaacacagtcaagctcaacctcagcagtctcagaacaggccattgtcattcggtggagacgacggaactgctctttacaagcagccgatgagatcagtatcaccaccgcagcagtaccaacccaactcagctggtgagaattctgtcttgaacatgaacttgcccggaggtgagtctggaggcatgactggaactggaagtgagccagtgaaaaagaggagaggtagaccgaggaaatatgggcctgatagtggtgaaatgtcacttggtttgaatcctggagctccttctttcactgtcagccaacctagtagcggcggcgatggaggagagaagaagagaggaagacctcctggttcttctagcaaaaggctcaagcttcaagctttaggctcgactggaatcggatttacgcctcatgtacttaccgtgctggctggagaggatgtatcatccaagataatggcgttaactcataatggaccccgtgctgtgtgtgtcttgtctgcaaatggagccatctccaatgtgactctccgccagtctgccacatccggtggaactgttacatatgaggggagatttgagattctgtctttatcgggatctttccatttgctggagaacaatggtcaaagaagcaggacgggaggtctaagcgtgtcattatcaagtccggatggtaatgtcctcggtggcagtgtagctggtcttcttatagcagcatcacctgttcagattgttgttgggagtttcttaccagacggagaaaaagaaccaaaacagcatgtgggacaaatgggactgtcgtcacccgtattaccgcgtgtggccccaacgcaggtgctgatgactccaagtagcccacaatctcgaggcacaatgagtgagtcatcttgtggaggaggacatggaagccctattcatcagagcactggaggaccttacaataacaccattaacatgccctggaagtagccaagtgatctgtgtcggcttaaaaccaacaacttcccgttattagagtgatttatttctacatttggtttagactttctagttctgatggttatttctacagttggtttagactttctagttctgttcagacaaaaggagtttgataaattgaccgacctattttgtgtgtttgaggtactttcagaaccataggtgttcagaaattagaatgttctgtttaaaaaa

SEQ ID NO: 1012 - protein, 351 aa, Arabidopsis thaliana
MSGSETGLMAATRESMQFTMALHQQQQHSQAQPQQSQNRPLSFGGDDGTALYKQPMRSVSPPQQYQPNSAGENSVLNMNLPGGESGGMTGTGSEPVKKRRGRPRKYGPDSGEMSLGLNPGAPSFTVSQPSSGGDGGEKKRGRPPGSSSKRLKLQALGSTGIGFTPHVLTVLAGEDVSSKIMALTHNGPRAVCVLSANGAISNVTLRQSATSGGTVTYEGRFEILSLSGSFHLLENNGQRSRTGGLSVSLSSPDGNVLGGSVAGLLIAASPVQIVVGSFLPDGEKEPKQHVGQMGLSSPVLPRVAPTQVLMTPSSPQSRGTMSESSCGGGHGSPIHQSTGGPYNNTINMPWK

SEQ ID NO: 1013 - DNA, 2052 bp, Arabidopsis thaliana
  misc_feature (2033)..(2033): n=a,t,c or g
aaaaaaaaaaaaaacctattcccaaagatgaagaacaataacaacaaatcttcttcttcttctagctatgattcttctttgtctccttcttcttcatcctcctcccaccagaactggctctctttctctctctccaacaataacaacaacttcaattcttcctcaaaccctaatctcacttcctccacatcagatcatcatcatcctcacccttctcacctctctctctttcaagctttctccacttctccagtcgaacggcaagatgggtcaccgggagtttcacccagcgatgccacggcggttctttccgtataccccggcggtcctaaacttgagaacttcctcggcggaggagcctcaacgacgacaacaagaccaatgcaacaagtgcaatctcttggcggcgttgtcttctcttccgacctacagccaccgcttcatcctccgtccgccgccgagatctacgactctgagctcaagtcaatagccgctagcttcctaggaaactactccggtggacactcgtcggaggtctctagcgtacataaacaacaaccgaatcctctagctgtctcagaggcttcgcctactccgaagaagaacgtagagagttttggacaacgtacctcgatttatagaggagtcacaagacatagatggactggaagatacgaagctcatctatgggataatagttgccgaagagaaggccaaagcagaaaaggaagacaagtttatttaggtggttatgataaggaagataaagcagctagagcttacgaccttgcagctcttaagtattggggtcctacaactacgactaatttcccgatatcaaattacgaatctgaacttgaagaaatgaaacacatgactcgacaagagttcgttgcttctttaagacggaaaagcagtggattctctaggggtgcctccatgtacagaggcgtcactagacatcatcagcatggtcgatggcaggcacgaattggaagagttgcaggcaacaaagacctttatcttggcacatttagcactcaagaggaagctgcagaagcttatgatatagcagcgatcaaattccgcggtctaaatgcagtcaccaatttcgacatcagtcgatatgatgtcaaatcaattgctagctgtaatctccctgtgggtggactaatgcctaaaccttctccagcaaccgcagcggctgacaaaaccgttgatctttctccatccgactctccatctctaaccacaccgtccctcacgttcaatgtggcaacaccggtcaatgaccatggaggaactttttaccacactggtataccaatcaaaccagacccggctgatcattattggtccaacatctttggattccaggcaaacccgaaagcagaaatgcgaccattagcaaactttgggtcggatcttcataacccttctcctggttatgctataatgccggtaatgcaggaaggtgaaaacaactttggtggtagttttgttgggtctgatgggtataacaatcattccgctgcatcgaacccggtctcagcaattccgctgtcctcgacaactacaatgagtaacggtaacgaagggtatggtggaaacataaactggattaataacaacatttcaagttcttaccaaactgcaaaatcaaatctctctgttttgcacacaccggtttttgggttggaatgagtattcacatcttagtgagaactaaaataaatatgtaggaaaaaaataaggctctgtttgaagaaatcagatattttcttcttagattatttaagtagtttaaaaaaaatattttttaagtgtttcacttttacgtttgtctgctgaccacgaattttgctggatctgacagtactaactctttgtttaatgaccttatgggttccttttttactttccagaacttttatttacttttttcttcatttttcttcattttttttgttgtgggacaatatgaatgattgaagatggaaactgcttgcatgtgaataaacgaaaatcaaacnatcttcggtaacttaaaaa

SEQ ID NO: 1014 - protein, 558 aa, Arabidopsis thaliana
MKNNNNKSSSSSSYDSSLSPSSSSSSHQNWLSFSLSNNNNNFNSSSNPNLTSSTSDHHHPHPSHLSLFQAFSTSPVERQDGSPGVSPSDATAVLSVYPGGPKLENFLGGGASTTTTRPMQQVQSLGGVVFSSDLQPPLHPPSAAEIYDSELKSIAASFLGNYSGGHSSEVSSVHKQQPNPLAVSEASPTPKKNVESFGQRTSIYRGVTRHRWTGRYEAHLWDNSCRREGQSRKGRQVYLGGYDKEDKAARAYDLAALKYWGPTTTTNFPISNYESELEEMKHMTRQEFVASLRRKSSGFSRGASMYRGVTRHHQHGRWQARIGRVAGNKDLYLGTFSTQEEAAEAYDIAAIKFRGLNAVTNFDISRYDVKSIASCNLPVGGLMPKPSPATAAADKTVDLSPSDSPSLTTPSLTFNVATPVNDHGGTFYHTGIPIKPDPADHYWSNIFGFQANPKAEMRPLANFGSDLHNPSPGYAIMPVMQEGENNFGGSFVGSDGYNNHSAASNPVSAIPLSSTTTMSNGNEGYGGNINWINNNISSSYQTAKSNLSVLHTPVFGLE

SEQ ID NO: 1015 - DNA, 1107 bp, Arabidopsis thaliana
atggggatgaagaaggtgaagctatctttgatagctaatgaaagatcaaggaaaacatccttcataaagaggaaagacgggatttttaagaaactccacgagttgtcaactctgtgtggtgtccaagcttgtgctctcatctacagtccattcataccggttccagagtcatggccgtcaagggaaggtgctaaaaaggtggcttcaaggtttctggagatgccgccgacagcccgaaccaagaagatgatggatcaagagacttaccttatggagaggattaccaaagcaaaagagcaactaaagaacctggctgctgagaaccgagagttacaggttagacgatttatgtttgattgtgttgaaggcaaaatgtcccagtatcattatgatgcaaaagaccttcaagatttgcaatcttgtataaatctatatctcgatcagcttaacggaaggatcgagtccattaaagaaaatggtgagtcgttgttgtcttccgtctctccttttcctactagaattggtgttgacgaaattggtgatgagtcattttccgactctcctattcatgctacaactggggttgtagatactcttaatgctaccaatcctcatgttcttacgggcgatatgactccttttcttgatgcggacgcaactgcggtaactgcttccagtagattttttgatcatattccatatgaaaatatgaatatgagtcaaaatctgcatgaaccgtttcaacaccttgttcctactaacgtttgtgatttttttcaaaatcagaatatgaatcaggttcaataccaggctcctaataatctgtttaatcagattcaacgagaattctacaacataaatttgaatctgaatttgaatctgaattcgaatcagtatctgaatcaacaacaatcattcatgaatccgatggtggaacaacatatgaatcatgttggagggcgtgaaagcattcctttcgtggacggaaactgctacaactaccatcaactaccatccaatcaactaccagccgttgatcatgcttccaccagttacatgccttccaccaccggtgtctatgatccttacatcaacaataatctctaa

SEQ ID NO: 1016 - protein, 368 aa, Arabidopsis thaliana
MGMKKVKLSLIANERSRKTSFIKRKDGIFKKLHELSTLCGVQACALIYSPFIPVPESWPSREGAKKVASRFLEMPPTARTKKMMDQETYLMERITKAKEQLKNLAAENRELQVRRFMFDCVEGKMSQYHYDAKDLQDLQSCINLYLDQLNGRIESIKENGESLLSSVSPFPTRIGVDEIGDESFSDSPIHATTGVVDTLNATNPHVLTGDMTPFLDADATAVTASSRFFDHIPYENMNMSQNLHEPFQHLVPTNVCDFFQNQNMNQVQYQAPNNLFNQIQREFYNINLNLNLNLNSNQYLNQQQSFMNPMVEQHMNHVGGRESIPFVDGNCYNYHQLPSNQLPAVDHASTSYMPSTTGVYDPYINNNL

SEQ ID NO: 1017 - DNA, 1634 bp, Arabidopsis thaliana
cttccttttgcttcagctgcgagctttggttggatctctcacttgcaaaaccaaatcccttatcgacttccaccgaaagatcacttcttaacctacacaaggtgtttgttatgaagatcagataaataaaaggtcatttgaggataatggttgatgttcaaagattcttacttgcttatttgtgatggacaatgtaagaggttcaataatgttgcagccactgccagagatagctgagagtatcgatgatgctatctgccatgaactctccatgtggcctgatgatgctaaagatttgttattgatagtggaggcaatatcaaggggagacttgaagttggtacttgttgcttgtgcaaaagctgtttctgagaataatcttctaatggcacgatggtgtatgggtgagttgcgcggtatggtttcgatttctggtgagccaatccagagattgggagcttatatgttagaagggcttgttgctaggcttgctgcttctggtagttcgatatataagtctctccagtccagagaaccagagagttatgaatttttatcttatgtgtatgttctgcatgaggtttgtccatatttcaagtttggatacatgtcagcgaatggtgcgattgcagaagcaatgaaggatgaagagaggattcacattattgacttccaaattggacaagggagccagtggatagcacttatccaggcttttgcagctaggcctggtggggctccaaatattcgaattaccggagttggtgatggatctgtcttggttacagtcaagaagagactagagaaacttgcaaagaagtttgatgttccattcaggttcaatgcggtttcaaggccaagttgtgaagttgaagtggaaaatcttgatgtccgagatggcgaagcccttggagtgaactttgcttacatgctgcatcatttgccagatgagagtgtaagcatggaaaaccacagggaccggttgctgaggatggtgaagagtctatcacctaaagtagtcactcttgtggaacaagaatgcaacacgaacacttcccctttccttcctaggttccttgagacattaagttattacacggcaatgttcgaatctatcgatgttatgcttccgagaaatcacaaggaaaggatcaatatcgagcagcactgcatggcaagggatgtcgtcaacatcatagcttgtgaaggagccgagaggatcgaaagacacgagcttctcgggaaatggaagtcaaggttttccatggcgggttttgagccataccccttgagctcaatcatttcagccaccattagagccctcttgagagattacagcaacgggtatgcgattgaagaaagagatggtgctctgtaccttggttggatggaccgaatcttggtctcatcttgtgcatggaagtgaaagaataaacgtctccaagaatgtaatgcaaaagacagaactggaagtaatagatagttttgtctcataaccattaataaggttgaatcaaatcatatacatccccatgctacaactattacacaggctccatcaacaaagaagggctcttgttgtgttaccttctcttcctgtaactcttatttgaaccaaatggaagtggttacat

SEQ ID NO: 1018 - protein, 413 aa, Arabidopsis thaliana
MDNVRGSIMLQPLPEIAESIDDAICHELSMWPDDAKDLLLIVEAISRGDLKLVLVACAKAVSENNLLMARWCMGELRGMVSISGEPIQRLGAYMLEGLVARLAASGSSIYKSLQSREPESYEFLSYVYVLHEVCPYFKFGYMSANGAIAEAMKDEERIHIIDFQIGQGSQWIALIQAFAARPGGAPNIRITGVGDGSVLVTVKKRLEKLAKKFDVPFRFNAVSRPSCEVEVENLDVRDGEALGVNFAYMLHHLPDESVSMENHRDRLLRMVKSLSPKVVTLVEQECNTNTSPFLPRFLETLSYYTAMFESIDVMLPRNHKERINIEQHCMARDVVNIIACEGAERIERHELLGKWKSRFSMAGFEPYPLSSIISATIRALLRDYSNGYAIEERDGALYLGWMDRILVSSCAWK

SEQ ID NO: 1019 - DNA, 1205 bp, Arabidopsis thaliana
atgcaaaaataaacatagtaacaatactttaaactatttacaccactttaatcttattctccactctttgaacgtaatggagaagaaccatagtagtggagagtgggagaagatgaagaacgagatcaacgagctaatgatagaaggaagagactatgcacaccagtttggatcagcttcatctcaagaaacacgtgaacatttagccaaaaagattcttcaatcttaccacaagtctctcaccatcatgaactactccggcgaacttgaccaagtttctcagggtggaggaagccccaagagcgatgattccgatcaagaaccacttgtcatcaagagttcgaagaagtcaatgccaaggtggagttcaaaagtcagaattgcccctggagctggtgttgatagaacgctggacgatggattcagttggagaaagtacggccagaaggatattctcggagccaaatttccaagaggatactatagatgcacgtatagaaagtctcaaggatgtgaagccactaaacaagtccaaagatctgatgaaaatcagatgctccttgagatcagttaccgaggaatacattcttgctctcaagctgcaaatgtcggtacaacaatgccgatacaaaacctcgaaccgaaccagacccaagaacacggaaatcttgacatggtaaaggaaagtgtagacaactacaatcaccaagcacatttgcatcacaaccttcactatccattgtcatctaccccaaatctagagaataacaatgcctatatgcttcaaatgcgagatcaaaacatcgaatattttggatctacgagcttctctagtgatctaggaactagtatcaactacaattttccagcatctggctcggcttctcactcagcatcaaactctccgtccaccgtccctttggaatccccgtttgaaagctatgatccaaatcatccatatggaggatttggtgggttctattcttagttatctacttaagggagggacggaactttttacatgacctcttgattaaagagagagttttcataatagctaatcaatttcctattcaaatatccgagttttttttctaatcatgtttatcaattgtcttattacagaaggcttattttcaggtctatgttgaaataaatggatttgtactcgtaggtatgatccttgttatctaaaaaaaaaaaaa

SEQ ID NO: 1020 - protein, 303 aa, Arabidopsis thaliana
MEKNHSSGEWEKMKNEINELMIEGRDYAHQFGSASSQETREHLAKKILQSYHKSLTIMNYSGELDQVSQGGGSPKSDDSDQEPLVIKSSKKSMPRWSSKVRIAPGAGVDRTLDDGFSWRKYGQKDILGAKFPRGYYRCTYRKSQGCEATKQVQRSDENQMLLEISYRGIHSCSQAANVGTTMPIQNLEPNQTQEHGNLDMVKESVDNYNHQAHLHHNLHYPLSSTPNLENNNAYMLQMRDQNIEYFGSTSFSSDLGTSINYNFPASGSASHSASNSPSTVPLESPFESYDPNHPYGGFGGFYS

SEQ ID NO: 1021 - DNA, 658 bp, Arabidopsis thaliana
atcaatggaaggggttgacaacacaaatcctatgttaaccctagaagaaggcgaaaacaacaatcctttttcttccttagatgacaaaacattaatgatgatggctccttcgttaatcttttcgggcgatgtaggtccatcttcttcttcttgtactccagcaggttatcatctatctgctcagctggagaactttcgaggaggtggaggagagatgggaggattagtgagtaataatagcaataatagtgatcataataagaattgcaacaaaggaaaagggaagagaactttggcaatgcagaggatagcttttcatacaaggagtgatgatgatgttcttgatgatggttatcgttggcgaaagtacggtcagaaatctgtcaagaacaatgctcatcccaggagctattatagatgtacataccacacatgcaacgtgaagaaacaagtgcaaagactggcaaaagatccaaacgttgtcgtaacaacctacgaaggtgttcataatcatccttgtgagaagctcatggagactcttagccctctccttaggcaacttcagttcctctcaagagtttctgatctgtaattattgaatgttaattagtggtgtaatacattaattatgctttaatctctccattgaccctcaatc

SEQ ID NO: 1022 - protein, 195 aa, Arabidopsis thaliana
MEGVDNTNPMLTLEEGENNNPFSSLDDKTLMMMAPSLIFSGDVGPSSSSCTPAGYHLSAQLENFRGGGGEMGGLVSNNSNNSDHNKNCNKGKGKRTLAMQRIAFHTRSDDDVLDDGYRWRKYGQKSVKNNAHPRSYYRCTYHTCNVKKQVQRLAKDPNVVVTTYEGVHNHPCEKLMETLSPLLRQLQFLSRVSDL

SEQ ID NO: 1023 - DNA, 2169 bp, Arabidopsis thaliana
atgagtttcgtcgtcggcgtcggcggaagtggtagtggaagcggcggagacggtggtggtagtcatcatcacgacggctctgaaactgataggaagaagaaacgttaccatcgtcacaccgctcaacagattcaacgccttgaatcgagtttcaaggagtgtcctcatccagatgagaaacagaggaaccagcttagcagagaattgggtttggctccaagacaaatcaagttctggtttcagaacagaagaactcagcttaaggctcaacatgagagagcagataatagtgcactaaaggcagagaatgataaaattcgttgcgaaaacattgctattagagaagctctcaagcatgctatatgtcctaactgtggaggtcctcctgttagtgaagatccttactttgatgaacaaaagcttcggattgaaaatgcacaccttagagaagagcttgaaagaatgtctaccattgcatcaaagtacatgggaagaccgatatcgcaactctctacgctacatccaatgcacatctcaccgttggatttgtcaatgactagtttaactggttgtggaccttttggtcatggtccttcactcgattttgatcttcttccaggaagttctatggctgttggtcctaataataatctgcaatctcagcctaacttggctatatcagacatggataagcctattatgaccggcattgctttgactgcaatggaagaattgctcaggcttcttcagacaaatgaacctctatggacaagaacagatggctgcagagacattctcaatcttggtagctatgagaatgttttcccaagatcaagtaaccgagggaagaaccagaactttcgagtcgaagcatcaaggtcttctggtattgtcttcatgaatgctatggcacttgtcgacatgttcatggattgtgtcaagtggacagaactctttccctctatcattgcagcttctaaaacacttgcagtgatttcttcaggaatgggaggtacccatgagggtgcattgcatttgttgtatgaagaaatggaagtgctttcgcctttagtagcaacacgcgaattctgcgagctacgctattgtcaacagactgaacaaggaagctggatagttgtaaacgtctcatatgatcttcctcagtttgtttctcactctcagtcctatagatttccatctggatgcttgattcaggatatgcccaatggatattccaaggttacttgggttgaacatattgaaactgaagaaaaagaactggttcatgagctatacagagagattattcacagagggattgcttttggggctgatcgttgggttaccactctccagagaatgtgtgaaagatttgcttctctatcggtaccagcgtcttcatctcgtgatctcggtggagtgattctatcaccggaagggaagagaagcatgatgagacttgctcagaggatgatcagcaactactgtttaagtgtcagcagatccaacaacacacgctcaaccgttgtttcggaactgaacgaagttggaatccgtgtgactgcacataagagccctgaaccaaacggcacagtcctatgtgcagccaccactttctggcttcccaattctcctcaaaatgtcttcaatttcctcaaagacgaaagaacccgtcctcagtgggatgttctttcaaacggaaacgcagtgcaagaagttgctcacatctcaaacggatcacatcctggaaactgcatatcggttctacgtggatccaatgcaacacatagcaacaacatgcttattctgcaagaaagctcaacagactcatcaggagcatttgtggtctacagtccagtggatttagcagcattgaacatcgcaatgagcggtgaagatccttcttatattcctctcttgtcctcaggtttcacaatctcaccagatggaaatggctcaaactctgaacaaggaggagcctcgacgagctcaggacgggcatcagctagcggttcgttgataacggttgggtttcagataatggtaagcaatttaccgacggcaaaactgaatatggagtcggtggaaacggttaataacctgataggaacaactgtacatcaaattaaaaccgccttgagcggtcctacagcttcaactacagcttga

SEQ ID NO: 1024 - protein, 722 aa, Arabidopsis thaliana
MSFVVGVGGSGSGSGGDGGGSHHHDGSETDRKKKRYHRHTAQQIQRLESSFKECPHPDEKQRNQLSRELGLAPRQIKFWFQNRRTQLKAQHERADNSALKAENDKIRCENIAIREALKHAICPNCGGPPVSEDPYFDEQKLRIENAHLREELERMSTIASKYMGRPISQLSTLHPMHISPLDLSMTSLTGCGPFGHGPSLDFDLLPGSSMAVGPNNNLQSQPNLAISDMDKPIMTGIALTAMEELLRLLQTNEPLWTRTDGCRDILNLGSYENVFPRSSNRGKNQNFRVEASRSSGIVFMNAMALVDMFMDCVKWTELFPSIIAASKTLAVISSGMGGTHEGALHLLYEEMEVLSPLVATREFCELRYCQQTEQGSWIVVNVSYDLPQFVSHSQSYRFPSGCLIQDMPNGYSKVTWVEHIETEEKELVHELYREIIHRGIAFGADRWVTTLQRMCERFASLSVPASSSRDLGGVILSPEGKRSMMRLAQRMISNYCLSVSRSNNTRSTVVSELNEVGIRVTAHKSPEPNGTVLCAATTFWLPNSPQNVFNFLKDERTRPQWDVLSNGNAVQEVAHISNGSHPGNCISVLRGSNATHSNNMLILQESSTDSSGAFVVYSPVDLAALNIAMSGEDPSYIPLLSSGFTISPDGNGSNSEQGGASTSSGRASASGSLITVGFQIMVSNLPTAKLNMESVETVNNLIGTTVHQIKTALSGPTASTTA

SEQ ID NO: 1025 - DNA, 1613 bp, Arabidopsis thaliana
cttgtaccagtttctgattagattcaacaatgaacggcgcattaggtaactcctccgcctccgttagcggcggagaaggagccggaggaccagcgcctttcttggtgaaaacctacgagatggtcgacgattcatcaacggaccagatcgtatcgtggagcgctaacaacaacagcttcatcgtttggaatcatgccgaattttcacgcctccttcttccaacctacttcaaacacaataacttctcttccttcattcgtcagctcaatacctatgggtttaggaagattgatccagagaggtgggagtttttgaatgatgattttattaaggatcagaagcatcttctcaagaatatacatagaaggaaacctatacacagccacagtcatccacctgcttcgtcgactgatcaagaaagagcagtgttgcaagagcaaatggacaagctttcacgtgagaaagctgcaattgaagctaagcttttaaagttcaaacaacagaaggttgtagcaaagcatcagtttgaagaaatgactgagcatgttgatgatatggagaataggcagaagaagctgctgaattttttggaaactgcgattcggaatcctacttttgttaagaattttggtaagaaagtcgagcagttggatatttcagcttacaacaaaaagcgaaggctccctgaagttgagcaatcaaagccaccttcagaagattctcatctggataatagtagtggtagctcgagacgcgagtctggaaacatttttcatcaaaatttctctaataaattgcgactagagctttctccagctgattcagatatgaacatggtttcacacagtatacaaagttccaatgaagaaggtgcgagtcccaaagggatactgtcaggaggtgatccaaatactacactaacaaaaagagaaggcctaccatttgcacctgaagctctagagcttgcggataccgggacatgcccgaggagattactgttaaatgataatacaagggtggagaccttgcagcagaggctaacttcttcagaggagactgatggtagcttttcatgtcatttaaatctaaccctggcttctgctccgttaccggacaaaacagcttcacagatagctaagacgactcttaaaagtcaggagttaaactttaactcaatagaaacaagtgcaagtgagaaaaatcggggtagacaagagattgcagttggaggtagccaagcaaatgcagctcctccagcaagagtgaatgatgtattctgggaacagttcctaacagaaaggccagggtcttcagataatgaggaggcaagttcgacttatagaggtaacccatacgaagagcaagaggagaaaagaaacgggagtatgatgttacgtaatacaaagaatatcgagcagctgaccttataaactatttggacggttacatcaacgagagtacgaactgaggttttggtaagaagtatgggtgagtaagtaatgaaacattggactgaaaaagcgtaagtagctttgttgtaaacacttgcgtctctgtctacacaagtaatttgactgtaaatgtaagtgtacaggatttaaattgaataagca

SEQ ID NO: 1026 - protein, 466 aa, Arabidopsis thaliana
MNGALGNSSASVSGGEGAGGPAPFLVKTYEMVDDSSTDQIVSWSANNNSFIVWNHAEFSRLLLPTYFKHNNFSSFIRQLNTYGFRKIDPERWEFLNDDFIKDQKHLLKNIHRRKPIHSHSHPPASSTDQERAVLQEQMDKLSREKAAIEAKLLKFKQQKVVAKHQFEEMTEHVDDMENRQKKLLNFLETAIRNPTFVKNFGKKVEQLDISAYNKKRRLPEVEQSKPPSEDSHLDNSSGSSRRESGNIFHQNFSNKLRLELSPADSDMNMVSHSIQSSNEEGASPKGILSGGDPNTTLTKREGLPFAPEALELADTGTCPRRLLLNDNTRVETLQQRLTSSEETDGSFSCHLNLTLASAPLPDKTASQIAKTTLKSQELNFNSIETSASEKNRGRQEIAVGGSQANAAPPARVNDVFWEQFLTERPGSSDNEEASSTYRGNPYEEQEEKRNGSMMLRNTKNIEQLTL

SEQ ID NO: 1027 - DNA, 911 bp, Arabidopsis thaliana
aacacacattccctctcttccttcaactagaaaaaagatagatatatcggacatttattgatctgtgtatgcataaaggtatagtatcattattagaaagatgaacacaacatcatcaaagagcaagaagaagcaagacgatcaggttggtacaaggtttcttggggtgagaagaaggccttggggaagatacgcagctgagattagagacccaactacgaaggagcgtcactggcttggcactttcgatacggcggaagaagctgccttggcctacgatagagctgctcggtccatgcgtggcacacgtgccagaaccaactttgtttactcagacatgcctccttcctcatccgtcacctccattgtttctcctgacgatcctcctcctcctccacctcctcctgctcctcctagcaatgatcctgtcgattacatgatgatgtttaaccaatactcatccactgactcgccaatgcttcagcctcattgtgatcaagtggacagttacatgtttggtggctctcaatcttcgaattcttattgctattctaatgacagtagtaatgagctgcctcctctcccgagcgacttgtcgaattcgtgttatagccaaccacagtggacctggaccggtgacgactactcgtctgagtacgtacatagtccaatgttcagcagaatgcctccggtttctgactctttccctcaaggtttcaactactttggctcctaattctttctcatcgtccatatttaataccttcctcatttgtaccttttccttcttcttcttttttgggtttatctatgtttcgccgtccttgatctctgcctatgtgatcaaagtgactgtttgtcattagtttttcaataacaagttatcatttgtatcttgaaaaaaaaaaaaa

SEQ ID NO: 1028 - protein, 211 aa, Arabidopsis thaliana
MNTTSSKSKKKQDDQVGTRFLGVRRRPWGRYAAEIRDPTTKERHWLGTFDTAEEAALAYDRAARSMRGTRARTNFVYSDMPPSSSVTSIVSPDDPPPPPPPPAPPSNDPVDYMMMFNQYSSTDSPMLQPHCDQVDSYMFGGSQSSNSYCYSNDSSNELPPLPSDLSNSCYSQPQWTWTGDDYSSEYVHSPMFSRMPPVSDSFPQGFNYFGS

SEQ ID NO: 1029 - DNA, 2157 bp, Arabidopsis thaliana
atggattttactcgcgatgacaactcaagtgatgaacgggaaaatgatgtagacgccaacaccaacaaccgtcacgagaagaagggttaccatcgccacactaatgaacaaattcataggcttgaaacgtatttcaaggaatgtcctcatccagacgaatttcagcgacgtctgttgggtgaagaactgaatctgaaaccaaaacaaatcaaattttggtttcaaaacaaaagaactcaagctaagagtcacaatgaaaaagcagacaatgcagcgcttagggcagaaaatattaagattagacgtgagaacgaatcaatggaagatgcactgaataatgtggtttgccctccatgtggtggtcgtggtcctgggagagaagaccaacttcgacatctccaaaaactccgtgcacaaaacgcttatctcaaagatgagtatgaaagagtctcaaactacctaaaacagtacggaggtcactcaatgcataacgtcgaggccacaccctatctccatggtccatcaaaccatgcatcaacgtccaagaaccgtccagcattgtacggaacctcttctaaccgtctccccgagccttcaagcatatttagaggaccatacactcgtggaaacatgaacaccaccgcaccgcctcagccgcgaaagccgctggaaatgcagaatttccaaccactatctcaactggagaaaattgcaatgttggaagcagcggaaaaagcggtgtcagaggttttgagcctcattcaaatggatgatacaatgtggaaaaagtcgtctattgatgataggctcgtcattgatccagggctctatgagaaatattttactaagactaacacaaatggtcgtcctgagtcttctaaagatgtcgtggtggttcaaatggatgctggaaacttgatcgacatcttcttaactgcggagaaatgggcgaggctttttccaacaattgtgaacgaagctaaaacgattcacgtcttggattccgttgaccatcgaggaaaaactttctcaagagtgatttatgagcaactgcacatactgtcaccattggtgccaccgagggaatttatgatcctaaggacttgccaacaaattgaagacaatgtctggatgattgctgatgtgtcgtgtcatctcccaaacattgagtttgatctttcgtttcccatttgcaccaaacgtccctcaggtgtgctcattcaagccttgccccacggcttctctaaggtgacgtggatagagcatgtggtagtgaatgataatagagtgcggccacataagctttacagagacctcttatacggcggctttggctacggagctcgacgttggaccgttactcttgagaggacgtgtgagaggctgattttctccacctccgtccctgccttgcccaacaatgacaatcccggagttgtgcaaacaatacgaggcagaaatagcgtaatgcatttgggagaaagaatgttgaggaactttgcatggatgatgaaaatggttaacaaactcgacttctcgccacagtctgaaactaacaacagcggaattaggattggggtgcggataaacaatgaggcgggtcaaccgcccggtctcattgtctgtgctggttcatctttatccctccctctccctcctgtccaagtgtacgatttccttaagaatctggaggttcgtcaccagtgggacgttctgtgccatgggaatccagcgactgaggctgctcgtttcgtcaccggatcaaacccaaggaacactgtgtcttttctcgagccttcaattagggatattaatactaagctaatgatactccaagatagcttcaaagatgcattgggaggaatggtggcctacgctccaatggatctaaacaccgcctgcgctgccatttcaggcgatatcgatcctaccaccattccaatcctcccttccggttttatgatctcccgtgacggccgtccttccgagggcgaagccgagggtggcagctatacactcctcaccgtggctttccagatccttgtctccggtccgagttactctcctgataccaacctggaagtttctgccaccacagtcaataccttgattagctccaccgttcaaaggatcaaagccatgctcaagtgcgaatga

SEQ ID NO: 1030 - protein, 718 aa, Arabidopsis thaliana
MDFTRDDNSSDERENDVDANTNNRHEKKGYHRHTNEQIHRLETYFKECPHPDEFQRRLLGEELNLKPKQIKFWFQNKRTQAKSHNEKADNAALRAENIKIRRENESMEDALNNVVCPPCGGRGPGREDQLRHLQKLRAQNAYLKDEYERVSNYLKQYGGHSMHNVEATPYLHGPSNHASTSKNRPALYGTSSNRLPEPSSIFRGPYTRGNMNTTAPPQPRKPLEMQNFQPLSQLEKIAMLEAAEKAVSEVLSLIQMDDTMWKKSSIDDRLVIDPGLYEKYFTKTNTNGRPESSKDVVVVQMDAGNLIDIFLTAEKWARLFPTIVNEAKTIHVLDSVDHRGKTFSRVIYEQLHILSPLVPPREFMILRTCQQIEDNVWMIADVSCHLPNIEFDLSFPICTKRPSGVLIQALPHGFSKVTWIEHVVVNDNRVRPHKLYRDLLYGGFGYGARRWTVTLERTCERLIFSTSVPALPNNDNPGVVQTIRGRNSVMHLGERMLRNFAWMMKMVNKLDFSPQSETNNSGIRIGVRINNEAGQPPGLIVCAGSSLSLPLPPVQVYDFLKNLEVRHQWDVLCHGNPATEAARFVTGSNPRNTVSFLEPSIRDINTKLMILQDSFKDALGGMVAYAPMDLNTACAAISGDIDPTTIPILPSGFMISRDGRPSEGEAEGGSYTLLTVAFQILVSGPSYSPDTNLEVSATTVNTLISSTVQRIKAMLKCE

SEQ ID NO: 1031 - DNA, 1457 bp, Arabidopsis thaliana
cttttttgaagcccttttgacacaaaagaccagaacaagttgaagaaatatgaatacaacctcgacacattttgttccaccgagaaggtttgaagtttacgagcctctcaaccaaatcggtatgtgggaagaaagtttcaagaacaatggagacatgtatacgcctggctctatcataatcccgactaacgaaaaaccagacagcttgtcagaggatacttctcatgggacagaaggaactcctcacaagtttgaccaagaggcttccacatctagacatcctgataagatacagagaaggctagcacagaatcgagaggcagctaggaaaagtcgtttgcgcaagaaagcttatgttcagcagctagagactagccggttaaagctaattcatttagagcaagaactcgatcgtgctagacaacagggtttctatgtggggaacggagtagataccaatgctcttagtttctcagataacatgagctcagggattgttgcatttgagatggaatatggacattgggtggaagaacagaacaggcaaatatgtgaactaagaacggttttacatggacaagttagtgatatagagcttcgttctctagtcgagaatgccatgaaacattactttcaactcttccgaatgaagtcagccgctgcaaaaatcgatgttttctatgtcatgtccggaatgtggaaaacttcagcagagcggtttttcttgtggataggcggatttagaccctcagagcttctcaaggttctgttaccgcattttgatcctttgacggatcaacaacttttggatgtatgtaatctgaggcaatcatgtcaacaatcagaagatgcgttatcccaaggtatggagaaactgcaacatacattagcagagagtgtagcagccgggaaacttggtgaaggaagttatattcctcaaatgacttgtgctatggagagattggaggctttggtcagctttgtaaatcaagctgatcatctgagacatgagacattgcaacagatgcatcggatcttaaccacgcgacaagcggctagaggtttgttagcattaggggagtatttccaaaggcttcgagctttgagttcgagttgggcggctaggcaacgtgaaccaacgtaattaaggtgtttagatgtcaagaaaggtttgagaccttaacaatcaagaatggagtttgctggtgagtggatttttgggtcaagaacaagagcaataacacaagctgctgtgtgatgatgaatcttgtcttgcggctaaaggaaatgtttgaggaaagttgtacatatgatcagcaacgtaaagtttatagctttttagaaaccaacttttcgatggttgttcttttttttttgtatgtaatattatagataagcttgtggtatatatgattttaatgtgacattacgaacttgatttataaccatggtaaaat

SEQ ID NO: 1032 - protein, 364 aa, Arabidopsis thaliana
MNTTSTHFVPPRRFEVYEPLNQIGMWEESFKNNGDMYTPGSIIIPTNEKPDSLSEDTSHGTEGTPHKFDQEASTSRHPDKIQRRLAQNREAARKSRLRKKAYVQQLETSRLKLIHLEQELDRARQQGFYVGNGVDTNALSFSDNMSSGIVAFEMEYGHWVEEQNRQICELRTVLHGQVSDIELRSLVENAMKHYFQLFRMKSAAAKIDVFYVMSGMWKTSAERFFLWIGGFRPSELLKVLLPHFDPLTDQQLLDVCNLRQSCQQSEDALSQGMEKLQHTLAESVAAGKLGEGSYIPQMTCAMERLEALVSFVNQADHLRHETLQQMHRILTTRQAARGLLALGEYFQRLRALSSSWAARQREPT

SEQ ID NO: 1033 - DNA, 1306 bp, Arabidopsis thaliana
aaagtatcatctcatagattccatcttttctctattacatggagaagaaaaaagaagaggatcatcatcatcaacaacaacaacaacaacaaaaggagatcaagaacacagagacaaagatcgagcaagaacaagaacaagaacaaaaacaagaaatctctcaagcatcatcatcatcaaacatggcgaatctagttacgtcatcagatcatcatccgttggagctagctggaaatctctcaagcatcttcgatacttcatctttaccttttccttattcttatttcgaagatcactcttctaataatcctaattctttcctagacttgctccgacaagatcatcagtttgcttcttcctctaattcctcttctttttcattcgatgcctttcctctccccaataacaacaacaacacctctttttttacggatttgcccttacctcaagctgagtcatcagaagtcgtgaacacaacaccgacttctccaaactcaacctcagtctcatcttcctccaacgaagctgcaaatgataacaacagtggtaaagaagttactgttaaagatcaagaagaaggagatcaacaacaagagcaaaagggtactaagccacagttgaaggcaaagaagaagaatcaaaagaaagctagagaagctaggtttgcgtttctgacgaagagcgatattgataatcttgacgacggttataggtggagaaaatacggccaaaaagctgtcaaaaacagtccttatcccagaagctattaccgttgcaccacagtgggttgcggagtgaagaagagagtggagagatcctccgatgatccttcgatcgtcatgacaacctacgaaggtcagcatacccatcctttccccatgacgccacgtggacacatcggaatgctcacgtcaccaatcctagaccacggtgcaaccaccgcgtcatcatcatcattctccatccctcagccacgttacttgctgactcaacatcaccagccctacaacatgtacaacaacaactctctaagtatgatcaatagaagatcatccgatggcactttcgtaaatccaggtccatcatcatcattccccggctttggttatgatatgtctcaagcttctacttcaacttcttcttccattagagatcatggattgcttcaagatattcttccttcgcagatcagatccgatactattaacactcaaaccaatgaagagaataagaaatgaagaagttttttttcccggggcaattgtttttttctttaggccggatccggtaggtaggtttcatgagc

SEQ ID NO: 1034 - protein, 399 aa, Arabidopsis thaliana
MEKKKEEDHHHQQQQQQQKEIKNTETKIEQEQEQEQKQEISQASSSSNMANLVTSSDHHPLELAGNLSSIFDTSSLPFPYSYFEDHSSNNPNSFLDLLRQDHQFASSSNSSSFSFDAFPLPNNNNNTSFFTDLPLPQAESSEVVNTTPTSPNSTSVSSSSNEAANDNNSGKEVTVKDQEEGDQQQEQKGTKPQLKAKKKNQKKAREARFAFLTKSDIDNLDDGYRWRKYGQKAVKNSPYPRSYYRCTTVGCGVKKRVERSSDDPSIVMTTYEGQHTHPFPMTPRGHIGMLTSPILDHGATTASSSSFSIPQPRYLLTQHHQPYNMYNNNSLSMINRRSSDGTFVNPGPSSSFPGFGYDMSQASTSTSSSIRDHGLLQDILPSQIRSDTINTQTNEENKK

SEQ ID NO: 1035 - DNA, 1260 bp, Arabidopsis thaliana
cccacgcgtccgcccacgcgtccgaaacaaaaacatataatttgggtttttagagttcgaaacttgaaatctttttttttttggttgctgaggaatcgaagtagaagagtataaatgggtgttagagagaaagatccgttagcccagttgagtttgccaccaggttttagattttatccgacagatgaagagcttcttgttcagtatctatgtcggaaagttgcaggctatcatttctctctccaggtcatcggagacatcgatctctacaagttcgatccttgggatttgccaagtaaggctttgtttggagagaaggaatggtatttctttagcccaagagatcggaaatatccgaacgggtcaagacccaatagagtagccgggtcgggttattggaaagcaacgggtactgacaaaattatcacggcggatggtcgtcgtgtcgggattaaaaaagctctggtcttttacgccggaaaagctcccaaaggcactaaaaccaactggattatgcacgagtatcgcttaatagaacattctcgtagccatggaagctccaagttggatgattgggtgttgtgtcgaatttacaagaaaacatctggatctcagagacaagctgttactcctgttcaagcttgtcgtgaagagcatagcacgaatgggtcgtcatcgtcttcttcatcacagcttgacgacgttcttgattcgttcccggagataaaagaccagtcttttaatcttcctcggatgaattcgctcaggacgattcttaacgggaactttgattgggctagcttggcaggtcttaatccaattccagagctagctccgaccaatggattaccgagttacggtggttacgatgcgtttcgagcggcggaaggtgaggcggagagtgggcatgtgaatcggcagcagaactcgagcgggttgactcagagtttcgggtacagctcgagtgggtttggtgtttcgggtcaaacattcgagtttaggcaatgagagagatgtgaagttactgatgggtgaaaaaagtaaaaaaaaaacttggagatagtagagtggcaattgatgtaaataatagggatttatatggggcttttaccgattcggtgaggcttaggattccccaaaggaaaaaggctcgactggggactagtttgatccaacttgacggcccccaaatgtgtaatgtttctcaacggagagaaaaataaatggttaccaatatttttccaaaaaaaaaaaaaaaaa

SEQ ID NO: 1036 - protein, 297 aa, Arabidopsis thaliana
MGVREKDPLAQLSLPPGFRFYPTDEELLVQYLCRKVAGYHFSLQVIGDIDLYKFDPWDLPSKALFGEKEWYFFSPRDRKYPNGSRPNRVAGSGYWKATGTDKIITADGRRVGIKKALVFYAGKAPKGTKTNWIMHEYRLIEHSRSHGSSKLDDWVLCRIYKKTSGSQRQAVTPVQACREEHSTNGSSSSSSSQLDDVLDSFPEIKDQSFNLPRMNSLRTILNGNFDWASLAGLNPIPELAPTNGLPSYGGYDAFRAAEGEAESGHVNRQQNSSGLTQSFGYSSSGFGVSGQTFEFRQ

SEQ ID NO: 1037 - DNA, 885 bp, Arabidopsis thaliana
atggaccatcatcagtatcatcatcatgatcaataccaacatcagatgatgactagtactaacaataattcctataacaccatcgtcacaacacaaccaccaccaacaacaacaacaatggattcaacaacagcaacaactatgataatggatgacgagaagaagttgatgacgacaatgagcactaggccgcaagaaccaagaaactgtccaagatgcaactcaagcaacaccaagttttgttattacaacaactacagcttagcacagcctaggtacttgtgtaagtcttgtcggagatattggactgaaggtggctctctccgtaacgtccccgtaggcggaggttctagaaagaacaagaagcttccatttcctaattcctctacttcttcttccaccaagaacctcccggatctcaaccctcctttcgtcttcacatcatcagcttcatcatcaaaccctagcaagacgcatcaaaacaataatgacctcagcctatccttctcctcccctatgcaagacaagcgagctcaagggcattacggtcatttcagtgagcaagttgtgacaggagggcagaactgtcttttccaagctcctatgggaatgattcagtttcgtcaagagtatgatcatgagcaccccaaaaagaatcttgggttttcattagacaggaacgaggaagagattggtaatcatgataacttcgttgttaatgaggaaggaagtaagatgatgtatccttatggagatcatgaagaccgtcaacaacatcaccatgtgagacacgatgatggtaataagaagagagaaggtggttcaagcaatgagctatggagcggaatcatcctaggtggtgatagtggtggaccaacatggtga

SEQ ID NO: 1038 - protein, 294 aa, Arabidopsis thaliana
MDHHQYHHHDQYQHQMMTSTNNNSYNTIVTTQPPPTTTTMDSTTATTMIMDDEKKLMTTMSTRPQEPRNCPRCNSSNTKFCYYNNYSLAQPRYLCKSCRRYWTEGGSLRNVPVGGGSRKNKKLPFPNSSTSSSTKNLPDLNPPFVFTSSASSSNPSKTHQNNNDLSLSFSSPMQDKRAQGHYGHFSEQVVTGGQNCLFQAPMGMIQFRQEYDHEHPKKNLGFSLDRNEEEIGNHDNFVVNEEGSKMMYPYGDHEDRQQHHHVRHDDGNKKREGGSSNELWSGIILGGDSGGPTW

SEQ ID NO: 1039 - DNA, 1038 bp, Arabidopsis thaliana
atgggcagatcgccatgttgtgataaggccgggttgaagaaagggccttggactccagaagaggatcagaaacttttggcttatattgaagaacatggccatggaagctggcgttctttgcctgagaaagccggtctccaaaggtgtggaaagagttgcagactcagatggactaactacctaagacctgacatcaagagaggcaaattcactgtacaagaagaacaaaccatcattcaactccacgctctcctcggaaacaggtggtcagcgattgcaactcatttaccaaagaggacagacaacgagatcaagaactactggaacacacacttgaagaaacgtctgatcaaaatggggatagatccagtgactcacaagcacaaaaacgagactctttcgtcttccacaggacaatcaaagaacgcagccacgcttagtcatatggctcaatgggagagtgcaagactcgacgctgaagcaaggctagctagagaatcaaagcttctccatttacagcattaccaaaacaataacaaccttaacaaatcagcagctcctcaacaacattgcttcactcaaaaaacatcaacaaactggactaaaccaaaccaaggaaacggagaccaacagcttgaatctccgacatcgacggtgacattctctgagaatcttctgatgcctttaggaatccctacggatagcagcagaaatagaaacaataacaacaatgagtcctcggcgatgattgaattggccgtatcttcgtcaacctcctccgatgtgagtctggtcaaagaacatgaacacgactggattaggcagatcaactgtggtagtggaggaataggagaaggattcacgagtctattgatcggtgattcggtcggccggggtttacccaccgggaaaaacgaagcgacggcgggcgtggggaatgagagtgagtataactactatgaggataacaagaattactggaatagcattctcaacttggttgattcttcaccgtccgattccgcgacgatgttctga

SEQ ID NO: 1040 - protein, 345 aa, Arabidopsis thaliana
MGRSPCCDKAGLKKGPWTPEEDQKLLAYIEEHGHGSWRSLPEKAGLQRCGKSCRLRWTNYLRPDIKRGKFTVQEEQTIIQLHALLGNRWSAIATHLPKRTDNEIKNYWNTHLKKRLIKMGIDPVTHKHKNETLSSSTGQSKNAATLSHMAQWESARLDAEARLARESKLLHLQHYQNNNNLNKSAAPQQHCFTQKTSTNWTKPNQGNGDQQLESPTSTVTFSENLLMPLGIPTDSSRNRNNNNNESSAMIELAVSSSTSSDVSLVKEHEHDWIRQINCGSGGIGEGFTSLLIGDSVGRGLPTGKNEATAGVGNESEYNYYEDNKNYWNSILNLVDSSPSDSATMF

SEQ ID NO: 1041 - DNA, 825 bp, Arabidopsis thaliana
atggggagaactaaggagcaggcaacattaactcggtatccaccctgtcctaggaatcctgctaaattcaatgatataaacaaagcactccaggaaaaaggatatggtaaggctctgaaaagaaaaccttggacgggtgtgacatgccctgtctgtcttgaggttcctcacaactcggtcgtcctcctttgttcatcttaccacaaaggatgccgtccgtacatgtgtgccacgggaaaccgtttctcaaattgtctagagcagtacaaaaaggcatatgccaaggatgagaaaagtgacaaaccgccagagctattgtgcccgctttgtaggggtcaggtgaaaggctggaccgttgtggaaaaggaacgtaagtatctgaattctaagaaaaggtcatgcatgaacgacgagtgtttgttttatggaagctatagacagctcaagaagcatgttaaggagaaccatccgagagccaagccaagagccatagaccctgtgctggaggcgaaatggaagaagcttgaggttgagagggagaggagtgatgtaatcagcacagtcatgtcgtcaacacctggggctatggtatttggagactatgtgattgagccatacaatggttatgatcatcaagatgacagtgacgattacagtgattcgtcggatgacgaaatggaaggtggggtattcgagcttggagcattcgacctgggccgtcttcaaccgcgttcggctgccatctcaagccggggaattcgcggtatgatcataaggaaccggtgggctcgaagcagaggtgcgagcagaaggcgacaaacataa

SEQ ID NO: 1042 - protein, 274 aa, Arabidopsis thaliana
MGRTKEQATLTRYPPCPRNPAKFNDINKALQEKGYGKALKRKPWTGVTCPVCLEVPHNSVVLLCSSYHKGCRPYMCATGNRFSNCLEQYKKAYAKDEKSDKPPELLCPLCRGQVKGWTVVEKERKYLNSKKRSCMNDECLFYGSYRQLKKHVKENHPRAKPRAIDPVLEAKWKKLEVERERSDVISTVMSSTPGAMVFGDYVIEPYNGYDHQDDSDDYSDSSDDEMEGGVFELGAFDLGRLQPRSAAISSRGIRGMIIRNRWARSRGASRRRQT

SEQ ID NO: 1043 - DNA, 3174 bp, Arabidopsis thaliana
atggcgagaaattcgaattccgatgaggctttctcgtcagaggaggaagaagagcgggttaaggataatgaagaagaagatgaggaggagctcgaggctgttgctcgttcttctggctccgacgatgacgaagtagccgccgccgacgaatcaccagtctccgacggagaggctgctcccgtagaagatgattacgaggacgaagaagatgaggaaaaagctgaaatcagcaaacgtgagaaagccagacttaaagagatgcagaagttgaagaagcagaagattcaagagatgctggagtcgcagaatgcttccattgacgcggatatgaacaataagggaaaagggagactgaagtatcttctgcagcaaactgagttatttgcccactttgctaaaagtgatggatcttcttctcagaagaaggcaaaaggaaggggacgtcatgcttccaaaataactgaagaggaggaagacgaagagtatctaaaggaagaagaggatggcttaactggatctggaaacacacggttactcacacagccctcttgtattcaagggaagatgagagattaccaattagctggtttgaactggctcattcgtctttatgagaatggcataaatggaattcttgctgatgaaatgggtctggggaagacgcttcaaacgatttctttgttggcatatcttcatgaatacaggggaatcaatggtccccatatggtggttgctccaaaatcaacacttggtaattggatgaacgaaattcgccggttttgtcctgtcctacgtgctgtgaagttccttggtaatcctgaggagaggagacatattcgagaagacctgctagttgctgggaaatttgatatttgtgtcacaagctttgagatggccatcaaagagaagacagcacttcgtcggtttagctggcgttatattatcattgatgaagcgcatcgaatcaagaacgagaattcactcctttctaaaaccatgagactttttagcaccaattatcggcttcttatcacggggaccccccttcagaataatctccatgaactgtgggctcttctaaattttcttctgcctgagatttttagttcagcagagacttttgatgaatggtttcaaatttctggtgagaatgaccagcaagaagttgtgcaacaactgcacaaggttcttcgaccatttcttcttcgaagactaaagtcagatgttgagaaaggtttgccaccgaagaaggagaccatacttaaagttggtatgtctcagatgcaaaagcaatactacaaggctttactgcagaaggatcttgaagcggttaatgctggtggagaacgcaaacgtctgctaaacattgcaatgcaactgcgtaaatgctgcaatcacccctatctcttccagggtgcagaacctggtcccccatataccacaggagatcaccttataacaaatgctggtaagatggttctcttggataaattgcttcctaagttgaaagaacgtgattcaagggtgctgatattttctcagatgacaagacttttggatattcttgaggactatttaatgtatcgtggttacttgtattgccgtattgatggaaacactggtggtgacgaacgagatgcctccatagaagcctacaacaagccaggaagtgagaaatttgttttcttgttatctactagagctggagggcttggtatcaatcttgctactgcagatgttgtgatcctttacgatagtgattggaacccacaagtcgacttgcaagctcaggatcgtgcccataggattggtcaaaaaaaagaagttcaagtgtttcgattctgcactgagtctgctattgaggagaaagtgattgaaagagcttacaagaagttagcacttgatgctctggttattcaacaagggagattggcagaacagaaaagtaagtctgtcaataaggatgagttgcttcaaatggtaagatatggtgctgagatggtgttcagttctaaagatagcacaatcacagacgaggatattgatagaatcattgccaaaggagaagaggcaacagctgaacttgatgctaagatgaagaaattcacagaagatgctatacagtttaaaatggatgacagtgctgacttctatgattttgatgatgacaataaggatgaaaacaagctcgattttaaaaagattgtaagcgacaattggaatgatccccccaagcgggagagaaagcgcaactactctgaatctgagtactttaagcaaacattgcggcaaggtgctccagctaaacctaaagagcctagaattccgcgcatgccccagttgcacgatttccagttctttaacattcagagattgaccgagttgtatgaaaaggaagtacgttatctcatgcaaacacatcagaaaaatcagttgaaagacacaattgatgttgaagaaccagaaggtggggatcccttaactactgaagaagtagaagaaaaggagggattattggaggagggtttctcaacatggagcagaagagattttaatactttcctcagggcttgtgagaagtatggccgcaacgacataaaaagcattgcctctgagatggaagggaaaacagaggaagaagttgaaagatatgccaaagtatttaaagagcggtacaaggagctgaacgactatgatagaatcattaagaacattgagaggggagaggcaaggatctctaggaaagacgaaatcatgaaggccatagggaagaaactggatcgctacagaaacccttggctggaactgaagattcaatatggtcagaacaaaggcaagctgtacaatgaagagtgtgaccgtttcatgatctgcatgattcacaaacttggttatgggaattgggatgagctaaaggcagcatttaggacatcgtctgtgttcaggtttgactggtttgtgaaatcccgcacgagtcaggaacttgcaagaagatgcgacactctgattcgactgatcgagaaagagaaccaggagtttgatgaaagagagaggcaagcccgcaaagagaagaagctcgcgaagagtgcaacaccatcaaagcgacctttaggaagacaagcaagtgagagtccttcatcgacgaagaagcggaagcacctgtcgatgagatga

SEQ ID NO: 1044 - protein, 1057 aa, Arabidopsis thaliana
MARNSNSDEAFSSEEEEERVKDNEEEDEEELEAVARSSGSDDDEVAAADESPVSDGEAAPVEDDYEDEEDEEKAEISKREKARLKEMQKLKKQKIQEMLESQNASIDADMNNKGKGRLKYLLQQTELFAHFAKSDGSSSQKKAKGRGRHASKITEEEEDEEYLKEEEDGLTGSGNTRLLTQPSCIQGKMRDYQLAGLNWLIRLYENGINGILADEMGLGKTLQTISLLAYLHEYRGINGPHMVVAPKSTLGNWMNEIRRFCPVLRAVKFLGNPEERRHIREDLLVAGKFDICVTSFEMAIKEKTALRRFSWRYIIIDEAHRIKNENSLLSKTMRLFSTNYRLLITGTPLQNNLHELWALLNFLLPEIFSSAETFDEWFQISGENDQQEVVQQLHKVLRPFLLRRLKSDVEKGLPPKKETILKVGMSQMQKQYYKALLQKDLEAVNAGGERKRLLNIAMQLRKCCNHPYLFQGAEPGPPYTTGDHLITNAGKMVLLDKLLPKLKERDSRVLIFSQMTRLLDILEDYLMYRGYLYCRIDGNTGGDERDASIEAYNKPGSEKFVFLLSTRAGGLGINLATADVVILYDSDWNPQVDLQAQDRAHRIGQKKEVQVFRFCTESAIEEKVIERAYKKLALDALVIQQGRLAEQKSKSVNKDELLQMVRYGAEMVFSSKDSTITDEDIDRIIAKGEEATAELDAKMKKFTEDAIQFKMDDSADFYDFDDDNKDENKLDFKKIVSDNWNDPPKRERKRNYSESEYFKQTLRQGAPAKPKEPRIPRMPQLHDFQFFNIQRLTELYEKEVRYLMQTHQKNQLKDTIDVEEPEGGDPLTTEEVEEKEGLLEEGFSTWSRRDFNTFLRACEKYGRNDIKSIASEMEGKTEEEVERYAKVFKERYKELNDYDRIIKNIERGEARISRKDEIMKAIGKKLDRYRNPWLELKIQYGQNKGKLYNEECDRFMICMIHKLGYGNWDELKAAFRTSSVFRFDWFVKSRTSQELARRCDTLIRLIEKENQEFDERERQARKEKKLAKSATPSKRPLGRQASESPSSTKKRKHLSMR

SEQ ID NO: 1045 - DNA, 1661 bp, Arabidopsis thaliana
cttcttcttcttcttcttcttcttcttcctcctctctcgtcggatctctctgatttagtgatttttcaaatttcaagttttcttcacctttaattttgtgtctcgttgatctctctttggacattctgctttggattctggaggcttctcattagatctctattagtgggtttaggtcaagttcttgaaatggataaggagaaatctcctgcaccaccacctagtggaggtcttcctccaccatcgggtcgttactctgcgttttcacctaatggaagtagctttgcaatgaaagctgaatcatcttttcctcctttgactccaagtggaagcaatagctcagatgctaaccgattcagccatgatattagccgaatgccggataatccacctaagaacctaggccatcgccgagctcattcagagattcttactcttcctgatgacttaagctttgatagtgatcttggtgtggttggtgctgctgatggaccttctttctctgatgatactgacgaggacttactctatatgtatcttgatatggaaaaattcaattcttctgctacatcgacttctcaaatgggtgagccatcagaaccgacttggaggaatgaattagcctcgacttctaaccttcagagtacacccggtagctctagtgaaagaccgagaattagacaccaacacagccaatcgatggatggttcaacaactatcaagcctgagatgcttatgtcagggaatgaagatgtgtctggagttgactctaagaaagccatctctgctgctaaactttctgagcttgctctcattgatccaaaacgcgccaagaggatatgggcaaacaggcagtctgctgcgaggtcaaaagaaaggaagatgagatacattgcagagctcgagagaaaagtacagactttacaaacagaggccacatctctctcagcccagttgactctcttacagagagatacaaatggcctgggtgttgaaaacaatgagcttaaactgcgagtacaaactatggagcaacaggtccacctacaggatgctttaaatgatgcactaaaggaggaagtccagcatcttaaggtattgacggggcaaggtccatcaaatggtacatcaatgaactacggttcttttggatcaaaccagcaattctatcccaataatcagtcgatgcacactatcttagccgcacaacagttacagcagctccagatccagtcacagaaacagcaacaacaacaacagcaacaccagcaacaacaacagcagcagcagcagcaatttcactttcaacagcagcaactgtaccagcttcagcagcagcaacggcttcaacaacaggaacaacaaagcggggcttcagagctaagaagacccatgccttctcctggtcagaaagagagtgtgacatcgcctgatcgtgaaactcccttgacaaaagactgagtctagactgtgctaatgtccaatttagtaagttactcttggaaaatcttctttttcatcgcaggctcatggatttgggatttactgcattatagagttaaaaacaagacagcttagaagttgcggatttagaagttgttagtgaagcttttgttctcgtctgttggtagtttacaatcttctctttgtatgatcctaag

SEQ ID NO: 1046 - protein, 423 aa, Arabidopsis thaliana
MDKEKSPAPPPSGGLPPPSGRYSAFSPNGSSFAMKAESSFPPLTPSGSNSSDANRFSHDISRMPDNPPKNLGHRRAHSEILTLPDDLSFDSDLGVVGAADGPSFSDDTDEDLLYMYLDMEKFNSSATSTSQMGEPSEPTWRNELASTSNLQSTPGSSSERPRIRHQHSQSMDGSTTIKPEMLMSGNEDVSGVDSKKAISAAKLSELALIDPKRAKRIWANRQSAARSKERKMRYIAELERKVQTLQTEATSLSAQLTLLQRDTNGLGVENNELKLRVQTMEQQVHLQDALNDALKEEVQHLKVLTGQGPSNGTSMNYGSFGSNQQFYPNNQSMHTILAAQQLQQLQIQSQKQQQQQQQHQQQQQQQQQQFHFQQQQLYQLQQQQRLQQQEQQSGASELRRPMPSPGQKESVTSPDRETPLTKD

SEQ ID NO: 1047 - DNA, 828 bp, Arabidopsis thaliana
atgggtggatcgatggcggagagagcaaggcaggccaacattcctccactagcgggacccctaaagtgtcctcgatgcgactccagcaacactaagttctgttactacaacaactataacctcactcagcctcgtcacttctgcaaaggttgccgtcgctactggacacaagggggcgccctgagaaacgtccctgtaggtggaggctgccggaggaataacaagaagggcaaaaatggaaatttaaaatcttcttcttcttcgtccaaacagtcttcctcggtcaacgctcaaagtcctagctcaggacagctaaggacaaatcatcagttccctttttcaccaactctttacaatctcactcaactcggaggtattggtttgaacttagccgctactaatggcaacaaccaagctcaccagatcggttccagtttgatgatgagcgatctagggtttctccatggacgaaatacttcaactccgatgacgggaaacattcatgaaaacaacaacaataataacaatgaaaacaacctaatggcatccgttggatctttgagcccctttgctctcttcgatccaacgacggggctatacgctttccagaacgacggtaatatcgggaacaacgttgggatatctggttcttctacttccatggttgattctagggtttatcagacgcctccggtgaagatggaagaacaacctaatttggctaacttgtctagaccggtctccggtttgacgtctcctgggaatcaaacaaatcagtacttttggcctggttcggatttctcgggtccttctaatgatctcttgtga

SEQ ID NO: 1048 - protein, 275 aa, Arabidopsis thaliana
MGGSMAERARQANIPPLAGPLKCPRCDSSNTKFCYYNNYNLTQPRHFCKGCRRYWTQGGALRNVPVGGGCRRNNKKGKNGNLKSSSSSSKQSSSVNAQSPSSGQLRTNHQFPFSPTLYNLTQLGGIGLNLAATNGNNQAHQIGSSLMMSDLGFLHGRNTSTPMTGNIHENNNNNNNENNLMASVGSLSPFALFDPTTGLYAFQNDGNIGNNVGISGSSTSMVDSRVYQTPPVKMEEQPNLANLSRPVSGLTSPGNQTNQYFWPGSDFSGPSNDLL

SEQ ID NO: 1049 - DNA, 704 bp, Arabidopsis thaliana
ttctctctgtgaatccttgttcatcgtcactgaaattagtttacaaaatcgacgaattcggagatgatttttcagaatgtgtgcagaaatgagtccaacttcaacgctatagcttccgaatcgcgttcccaaacgcagttcggtgtttcgaaatcctcctcgagcggcggcggatgtatctccgccaggactaaagaccgtcacacgaaggttaacggacgaagccgtcgagttacgatgccggctctcgccgccgctaggattttccagttaacgcgtgagctcggtcacaaaactgaaggagaaaccatcgaatggcttcttagtcaagctgaaccgtcgattattgccgccactggctacgggactaagctcatttcgaattgggttgatgttgcggcggacgattcctcgtcgtcgtcgtcgatgacgtcgccgcaaacgcaaacgcaaacgccacaatcgccgagttgtaggttggatctttgtcagccaatcggaattcagtatccggtgaatggttacagtcatatgccgttcacagcgatgcttttagagccgatgaccacgacggcggaatctgaggttgagatcgcggaggaggaggaacgtagacgccgtcaccattagtaaaattaggcttttgatttagagtgttaaaattaggattttaaaagtttaggaggtaacagataaggataatt

SEQ ID NO: 1050 - protein, 188 aa, Arabidopsis thaliana
MIFQNVCRNESNFNAIASESRSQTQFGVSKSSSSGGGCISARTKDRHTKVNGRSRRVTMPALAAARIFQLTRELGHKTEGETIEWLLSQAEPSIIAATGYGTKLISNWVDVAADDSSSSSSMTSPQTQTQTPQSPSCRLDLCQPIGIQYPVNGYSHMPFTAMLLEPMTTTAESEVEIAEEEERRRRHH

SEQ ID NO: 1051 - DNA, 1118 bp, Arabidopsis thaliana
caaacccaaattctctcagcgccggtcaaatacttgtctctctctctctctctctttcactcttgtcttgtctccttcgaagctgtttgttctgtaagaaagatggaagcaggtggcgcgtacaatccacgcactgttgaagaggtgtttagggattttaagggtcgtagagctggcatgattaaggctttaaccactgatgttcaggagtttttccgactttgtgatcccgaaaaggagaacctttgcctttacggacatccaaatgagcactgggaagtgaatttgccagctgaagaggttcctcctgagctcccagagcctgtcttgggtatcaattttgccagagacgggatggcggaaaaggattggttgtcccttgttgctgtccacagtgatgcttggcttcttgctgttgctttcttttttggagccaggtttggatttgacaaagctgataggaagaggcttttcaatatggtgaatgacctcccaacaatctttgaggttgtagctggcactgctaagaaacaaggaaaagataagtcctctgtttccaacaacagcagcaacagatccaaatcaagctccaagcgaggatctgaatcccgtgccaagttctcaaagccggagcccaaagatgatgaggaggaggaagaggaaggtgtggaagaggaggatgaggatgagcaaggtgaaacacagtgtggagcatgtggtgagagctatgcagctgatgagttctggatttgctgtgacctctgtgagatgtggtttcatggaaagtgtgttaagataacaccagcaagagctgagcacatcaagcaatacaagtgcccttcttgcagcaacaaaagggctcgttcctaaatttgttgaccgctcgcttctgtgtatctacctttgcatatgatgatgaacagcttaactgtttggtttagatcagatttgtcatatggatttggtaatttaggaagacattttagttttttcattgttacattttggcgattgaagggataactctttgtttaggggtaatgatcttttgctctgttttatgtttgtttattaacattcttcaaactcaatcaaaagtattttggttagtcttaaaa

SEQ ID NO: 1052 - protein, 255 aa, Arabidopsis thaliana
MEAGGAYNPRTVEEVFRDFKGRRAGMIKALTTDVQEFFRLCDPEKENLCLYGHPNEHWEVNLPAEEVPPELPEPVLGINFARDGMAEKDWLSLVAVHSDAWLLAVAFFFGARFGFDKADRKRLFNMVNDLPTIFEVVAGTAKKQGKDKSSVSNNSSNRSKSSSKRGSESRAKFSKPEPKDDEEEEEEGVEEEDEDEQGETQCGACGESYAADEFWICCDLCEMWFHGKCVKITPARAEHIKQYKCPSCSNKRARS

SEQ ID NO: 1053 - DNA, 989 bp, Arabidopsis thaliana
gtaccgtcgacgatccggcgatgtcaaacccgacccgtaagaatatggagaggattaaaggtccatggagtccagaagaagatgatctgttgcagaggcttgttcagaaacatggtccgaggaactggtctttgattagcaaatcaatccctggacgttccggcaaatcttgtcgtctccggtggtgtaaccagctatctccggaggtagagcaccgtgctttttcgcaggaagaagacgagacgattattcgagctcacgctcggtttggtaacaagtgggctacgatctctcgtcttctcaatggacgaaccgataacgctatcaagaatcattggaactcgacgctgaagcgaaaatgcagcgtcgaagggcaaagttgtgattttggtggtaatggagggtatgatggtaatttaggagaagagcaaccgttgaaacgtacggcgagtggtggtggtggtgtctcgactggcttgtatatgagtcccggaagtccatcgggatctgacgtcagcgagcaatctagtggtggtgcacacgtgtttaaaccaacggttagatctgaggttacagcgtcatcgtctggtgaagatcctccaacttatcttagtttgtctcttccttggactgacgagacggttcgagtcaacgagccggttcaacttaaccagaatacggttatggacggtggttatacggcggagctgtttccggttagaaaggaagagcaagtggaagtagaagaagaagaagcgaaggggatatctggtggattcggtggtgagttcatgacggtggttcaggagatgataaggacggaggtgaggagttacatggcggatttacagcgaggaaacgtcggtggtagtagttctggcggcggaggtggcggttcgtgtatgccacaaagtgtaaacagccgtcgtgttgggtttagagagtttatagtgaaccaaatcggaattgggaagatggagtaggcggcc

SEQ ID NO: 1054 - protein, 320 aa, Arabidopsis thaliana
MSNPTRKNMERIKGPWSPEEDDLLQRLVQKHGPRNWSLISKSIPGRSGKSCRLRWCNQLSPEVEHRAFSQEEDETIIRAHARFGNKWATISRLLNGRTDNAIKNHWNSTLKRKCSVEGQSCDFGGNGGYDGNLGEEQPLKRTASGGGGVSTGLYMSPGSPSGSDVSEQSSGGAHVFKPTVRSEVTASSSGEDPPTYLSLSLPWTDETVRVNEPVQLNQNTVMDGGYTAELFPVRKEEQVEVEEEEAKGISGGFGGEFMTVVQEMIRTEVRSYMADLQRGNVGGSSSGGGGGGSCMPQSVNSRRVGFREFIVNQIGIGKME

SEQ ID NO: 1055 - DNA, 1059 bp, Arabidopsis thaliana
actattacatgcctcttcctcgcttcaaaacggcaccgtttccacttgttattatttttctctctatcgtctaacaaaaaaaaaaactgacttgggattttttttcatttgtctagcccaaaagaagaagatagaaacgaagaaaaaaagcaaacacattttgggtccccggtggttaggatcaaattagggcacaaaccttatcggagaaagaagccatgggaagaagaaaagtcgagatcaagcgaatcgagaacaaaagcagtcgacaagtcactttctccaaacgacgcaaaggtctcatcgaaaaagctcgacaactttcaattctctgtgaatcttccatcgctgttgtcgccgtctccggttccggaaaactctacgactctgcctccggtgacaacatgtcaaagatcattgatcgttatgaaatacatcatgctgatgaacttaaagccttagatcttgcagaaaaaattcggaattatcttccacacaaggagttactagaaatagtccaaagcaagcttgaagaatcaaatgtcgataatgtaagtgtagattctctaatatctatggaggaacagctcgagactgctctgtcagtaattagagctaagaagacagaactaatgatggaggatatgaagtcacttcaagaaagggagaagttgctgatagaagagaaccagattctggctagccaggtggggaagaagacgtttctggttatagaaggtgacagaggaatgtcacgggaaaatggctccggcaacaaagtaccggagactctttcgctgctcaagtaatcaccatcatcaacggctgagctttcaccataaacttactcacagcctgattcagaagcttttacaaaattgtaaattataaaaagctgcataataatctcaacctttttatcttcctcgcgccaatgtggaaataaaggtaaaacaaaacgaagctcttttcttttatgcgaaagaattgtaaaactaagataaagctaccgatctttgttgtaccttagtagacaaatatcagagttcttgtgcttgt

SEQ ID NO: 1056 - protein, 196 aa, Arabidopsis thaliana
MGRRKVEIKRIENKSSRQVTFSKRRKGLIEKARQLSILCESSIAVVAVSGSGKLYDSASGDNMSKIIDRYEIHHADELKALDLAEKIRNYLPHKELLEIVQSKLEESNVDNVSVDSLISMEEQLETALSVIRAKKTELMMEDMKSLQEREKLLIEENQILASQVGKKTFLVIEGDRGMSRENGSGNKVPETLSLLK

SEQ ID NO: 1057 - DNA, 681 bp, Arabidopsis thaliana
atggatgatatagcggaacttgaatggttatcaaatttcgtagatgattcttctttcacgccgtattctgctccgacgaataaaccggtttggttaaccggaaatcggagacatcttgtacaaccggttaaagaggagacctgcttcaaatcccaacatccggccgtcaaaaccagacccaaacgagccagaaccggagtcagagtctggtctcatggttcgcagtcgttaaccgactcatcttcaagctctacaacatcttcgtcgtcctctcctcgtccttcaagccctctatggctcgccagcggtcagtttcttgatgagccaatgactaaaacacaaaagaagaagaaagtttggaaaaacgctggtcagacgcaaacgcaaacgcagacgcagacgcggcagtgtggtcattgtggagttcagaaaacgccgcagtggagagcaggaccattaggagcgaagacgttgtgtaatgcgtgtggtgtgcgttacaaatcgggtcggttactacccgaatatagacccgcttgtagcccaacattttcgagtgagcttcactcaaaccaccacagtaaagtcattgagatgcgtaggaagaaagagacttctgacggtgctgaagaaaccggtttgaaccagccggttcagacggttcaggttgtctcgagtttttga

SEQ ID NO: 1058 - protein, 226 aa, Arabidopsis thaliana
MDDIAELEWLSNFVDDSSFTPYSAPTNKPVWLTGNRRHLVQPVKEETCFKSQHPAVKTRPKRARTGVRVWSHGSQSLTDSSSSSTTSSSSSPRPSSPLWLASGQFLDEPMTKTQKKKKVWKNAGQTQTQTQTQTRQCGHCGVQKTPQWRAGPLGAKTLCNACGVRYKSGRLLPEYRPACSPTFSSELHSNHHSKVIEMRRKKETSDGAEETGLNQPVQTVQVVSSF

SEQ ID NO: 1059 - DNA, 2331 bp, Arabidopsis thaliana
atgaagcgtgagatgaaagcacctactactccactagagagtctccaaggtgacctcaaaggaaaacaagggaggacatctggccctgctagacgatctaccaaaggacaatggacacctgaagaggacgaagtcttgtgtaaagctgttgagcgttttcaaggaaagaactggaagaagatagctgaatgttttaaggatcggactgatgttcagtgtcttcatagatggcaaaaggtcttgaacccagagcttgtgaaaggaccgtggtcaaaagaggaggataacacaataattgacctggttgaaaaatatgggccaaagaaatggtctactatatctcagcatttacctgggcgcataggaaagcaatgtagggaaaggtggcataaccatcttaaccctgggattaataaaaatgcatggactcaggaagaggaactgactcttattcgtgcgcatcaaatttatgggaataaatgggcagagcttatgaaatttttgccaggaaggtcagataattcgataaaaaatcattggaacagctcagttaagaagaagttggattcctactatgcatcaggtcttttagatcagtgtcaaagctcgccattaattgcccttcagaacaaatctatcgcttcatcttcctcgtggatgcacagcaatggagatgaaggtagttcaaggccaggggttgatgctgaggaatcagaatgcagccaagcttcaactgttttctcacaatcaaccaacgatttacaagatgaagttcaacgtggaaatgaggaatattacatgcctgaatttcattcaggaacggagcagcaaatctcaaacgctgcatctcatgcagaaccgtactacccttcctttaaagatgtcaaaattgttgtccccgaaatttcttgtgaaacagaatgttcgaagaagtttcagaatcttaattgttctcacgagctaagaactaccacagctacggaggatcaattgccgggtgtatctaatgatgctaaacaggaccgtggtctagagttattgacccataacatggacaacggtggaaaaaaccaagcacttcaacaagattttcaaagttcagtaagattaagtgatcaaccttttttgtcaaactcggacacagatccagaagctcaaactttgatcacggatgaggagtgttgtagggttctttttccagataacatgaaagatagcagtacatcttctggtgagcaaggtcggaatatggttgaccctcaaaacggcaaaggatctctttgttctcaggctgcagaaacccatgctcatgaaactggaaaagttccagctttaccgtggcatccttcaagttctgagggcctggcgggtcataattgtgtccctttgttggattcagacttgaaggactcacttttaccccgtaatgattccaacgctcctatacaaggttgtcgcctttttggagctaccgaattagaatgtaagactgatacaaatgacggtttcatcgatacttacggacatgtaacttcccatggcaatgatgataatggtggtttcccagaacaacaggggctgtcatatattcccaaggattctttgaagctagtacctttgaatagtttttcttctccttctagagtgaacaagatttattttcctattgacgataagccggctgaaaaagacaaaggagctctttgttatgaacctccacgttttccaagtgcagatattcctttcttcagctgtgatcttgtaccatcaaatagtgacttacggcaagagtacagtccctttggtatccgtcagttgatgatttcttcaatgaattgtacaactccgttaaggttatgggattcaccgtgtcacgataggagccctgatgtcatgcttaatgatactgccaaaagttttagtggtgcaccatccatcttaaagaagcggcatcgagacttgctttcacctgtgcttgatagaagaaaagacaaaaagcttaaaagggctgcgacttcctccttggctaatgatttttcgcgcttagatgtaatgcttgatgaaggagatgattgcatgacctctcgtccgtcagagtctcctgaagataaaaatatatgtgcctccccttccatagccagagataacagaaattgtgcatcagctcggttatatcaagaaatgattccgatagatgaggaaccaaaggaaaccttagaatcaggtggagtgacttctatgcaaaatgaaaatggatgtaatgacggtggtgcttcagctaaaaatgtaagtccgtctttgtccttgcatattatctggtatcagttataa

SEQ ID NO: 1060 - protein, 776 aa, Arabidopsis thaliana
MKREMKAPTTPLESLQGDLKGKQGRTSGPARRSTKGQWTPEEDEVLCKAVERFQGKNWKKIAECFKDRTDVQCLHRWQKVLNPELVKGPWSKEEDNTIIDLVEKYGPKKWSTISQHLPGRIGKQCRERWHNHLNPGINKNAWTQEEELTLIRAHQIYGNKWAELMKFLPGRSDNSIKNHWNSSVKKKLDSYYASGLLDQCQSSPLIALQNKSIASSSSWMHSNGDEGSSRPGVDAEESECSQASTVFSQSTNDLQDEVQRGNEEYYMPEFHSGTEQQISNAASHAEPYYPSFKDVKIVVPEISCETECSKKFQNLNCSHELRTTTATEDQLPGVSNDAKQDRGLELLTHNMDNGGKNQALQQDFQSSVRLSDQPFLSNSDTDPEAQTLITDEECCRVLFPDNMKDSSTSSGEQGRNMVDPQNGKGSLCSQAAETHAHETGKVPALPWHPSSSEGLAGHNCVPLLDSDLKDSLLPRNDSNAPIQGCRLFGATELECKTDTNDGFIDTYGHVTSHGNDDNGGFPEQQGLSYIPKDSLKLVPLNSFSSPSRVNKIYFPIDDKPAEKDKGALCYEPPRFPSADIPFFSCDLVPSNSDLRQEYSPFGIRQLMISSMNCTTPLRLWDSPCHDRSPDVMLNDTAKSFSGAPSILKKRHRDLLSPVLDRRKDKKLKRAATSSLANDFSRLDVMLDEGDDCMTSRPSESPEDKNICASPSIARDNRNCASARLYQEMIPIDEEPKETLESGGVTSMQNENGCNDGGASAKNVSPSLSLHIIWYQL

SEQ ID NO: 1061 - DNA, 1116 bp, Arabidopsis thaliana
cgtcgactgtccataaatccggagcctgacccgacgtttgacccggatccgaaactcccacaatctccataccacccaaattcatctcccctaaagctttctctcactttcccgggaaaatcggcgaccaaaattggaaaatgtactcagcgattcgctcgcttccactcgatggtggacacgttggtggtgactaccatggacctcttgacggaaccaatcttcccggtgacgcttgtttggttttaacgactgaccctaaacctcgtctccggtggacaactgagcttcatgagagattcgttgacgccgttactcagctcggtggtcctgacaaagcgactcccaaaactattatgagaacaatgggagtgaagggtctcactctctaccacctcaaatcacatcttcagaaattccgcctagggaggcaagctggcaaagaatcaactgagaactctaaagatgcttcttgtgtaggggagagtcaggacacaggttcatcttcgacatcatcaatgagaatggcgcagcaggagcagaacgagggttaccaagtcaccgaagctctacgtgctcagatggaagtccaaagaagactacacgatcaattggaggtgcaacggaggctccagctgaggatagaggcacaaggaaaatacctgcaatcgattcttgaaaaagcttgcaaggcctttgacgagcaagctgctacttttgctggacttgaggctgctagggaagagctatcagagctagccatcaaagtctccaatagctctcaaggaacatcagtcccgtacttcgatgcaacaaagatgatgatgatgccatcgttgtcagagcttgcagtagcaatagacaacaaaaacaacatcacaaccaactgttcagtagaaagctctctgacttccatcacacatgggagctctatatctgctgcatcaatgaagaagcgtcaacgtggagacaatttgggcgtagggtatgaatcaggctggattatgcctagtagcaccattggataaagtttaggagagggaaaaagttcattatgggaaaggtagagataagatttaactgttctttacttgctttgaggggcctgcggccgct

SEQ ID NO: 1062 - protein, 295 aa, Arabidopsis thaliana
MYSAIRSLPLDGGHVGGDYHGPLDGTNLPGDACLVLTTDPKPRLRWTTELHERFVDAVTQLGGPDKATPKTIMRTMGVKGLTLYHLKSHLQKFRLGRQAGKESTENSKDASCVGESQDTGSSSTSSMRMAQQEQNEGYQVTEALRAQMEVQRRLHDQLEVQRRLQLRIEAQGKYLQSILEKACKAFDEQAATFAGLEAAREELSELAIKVSNSSQGTSVPYFDATKMMMMPSLSELAVAIDNKNNITTNCSVESSLTSITHGSSISAASMKKRQRGDNLGVGYESGWIMPSSTIG

SEQ ID NO: 1063 - DNA, 1440 bp, Arabidopsis thaliana
atggctcctgtctcgttacctccaggtttccgattccatccaacagacgaggaactaattacttactatctaaaaagaaagatcaacggtctagaaatcgaacttgaagttatcgctgaagttgatctttacaagtgtgagccatgggacttaccagggaagtccttgcttccgagcaaagaccaagaatggtacttcttcagcccacgagaccggaagtatcccaacggctcaaggacaaaccgggcaactaaaggcggttattggaaggctacaggtaaagaccgccgagttagttggagagaccgagccataggaaccaagaagacattggtttactaccgtgggcgcgcgccacatggcataagaactggttgggtcatgcacgaatatcgacttgatgaaacagaatgtgagccttctgcatacggcatgcaggacgcatatgcactttgtcgtgtgttcaaaaagattgttattgaagctaagccaagagatcaacatcggtcatatgtccacgcgatgtcgaatgtgagtggtaattgctcatcgagttttgacacttgttcggatctcgaaatcagttcaactactcatcaagttcaaaacacattccaaccgcgatttggcaacgagcgatttaactccaacgcaatcagcaacgaggattggtcacaatactacggttcttcttatagaccgttccctactccatataaggttaacacagagatcgaatgttcaatgttacaacacaatatatatctaccaccgttgcgtgtagagaactctgcgtttagtgattccgatttcttcacgagtatgactcacaacaacgaccatggcgttttcgatgactttacttttgctgcaagtaactccaaccacaataatagcgttggtgatcaagtgatccacgttggcaattatgatgaacaattaataacatctaaccgtcatatgaaccagactggttatataaaagagcagaagatcagatcgagtttggataatactgacgaagatccaggatttcatggtaacaataccaatgacaacatagatatcgatgattttctctcgtttgatatatataacgaggacaacgtgaatcaaatagaagataatgaagacgtgaatacaaatgaaacccttgattcatcgggattcgaggtggttgaagaagaaactagatttaacaaccaaatgctcatctcgacatatcaaacgacaaagattctatatcaccaagtcgtaccttgtcacacgttgaaagttcacgtcaatcctattagtcacaatgtggaagagagaacattgttcattgaagaggacaaagattcttggttacaaagagctgagaagatcacgaagacaaaactaacactttttagtttaatggctcagcaatactacaaatgtcttgctatttttttctga

SEQ ID NO: 1064 - protein, 479 aa, Arabidopsis thaliana
MAPVSLPPGFRFHPTDEELITYYLKRKINGLEIELEVIAEVDLYKCEPWDLPGKSLLPSKDQEWYFFSPRDRKYPNGSRTNRATKGGYWKATGKDRRVSWRDRAIGTKKTLVYYRGRAPHGIRTGWVMHEYRLDETECEPSAYGMQDAYALCRVFKKIVIEAKPRDQHRSYVHAMSNVSGNCSSSFDTCSDLEISSTTHQVQNTFQPRFGNERFNSNAISNEDWSQYYGSSYRPFPTPYKVNTEIECSMLQHNIYLPPLRVENSAFSDSDFFTSMTHNNDHGVFDDFTFAASNSNHNNSVGDQVIHVGNYDEQLITSNRHMNQTGYIKEQKIRSSLDNTDEDPGFHGNNTNDNIDIDDFLSFDIYNEDNVNQIEDNEDVNTNETLDSSGFEVVEEETRFNNQMLISTYQTTKILYHQVVPCHTLKVHVNPISHNVEERTLFIEEDKDSWLQRAEKITKTKLTLFSLMAQQYYKCLAIFF

SEQ ID NO: 1065 - DNA, 1308 bp, Arabidopsis thaliana
atgaaggacgcagagaagcgagaggtgattgcatcatcatcattacaaagaaagagaaacagaggaagaagactaaggaaaagaagaagaagaaacgagaagcgagtactaatggttccatcatcattaccaaacgacgtgctagaggagatctttttaagatttccggttaaagccctaatccgactcaagtctctctcgaaacaatggagatcgacgatcgaatctcgcagttttgaagagagacacttgacgatcgctaagaaagccttcgtggatcatcccaaggtcatgctcgtaggagaagaagatcccataagaggaaccgggattcgtccagacactgacattggttttaggttattctgcttggaatcggcttctcttctatcctttactcgtctcaatttccctcaagggttcttcaactggatctacatatctgaaagctgtgatggccttttctgcatccattccccaaaatcacattccgtatatgtagtgaatccggctacacggtggctccgcctacttcctccggcagggtttcagattttgatccacaagtttaaccccactgaacgtgagtggaatgtagtgatgaaatcaatctttcatctagcattcgtgaaggccaccgattacaaattagtgtggttgtacaattgtgataagtacattgttgatgcgtcgagtccaaacgtgggagtcacaaagtgcgagatttttgactttaggaaaaatgcttggaggtacttggcttgcactccaagtcatcagatattctattaccaaaagccagcatctgcaaacgggtcggtttattggtttacagaaccatataatgaaagaatcgaagtagtggcttttgatattcagaccgaaacattccggttgctgcctaagattaatccggctattgctggttcagatcctcaccatattgacatgtgcactctggataatagtttgtgtatgtcgaaaagggagaaagatactatgatccaagatatttggaggttgaaaccatcagaagacacatgggaaaagatttttagcatagacttggtttcctgtccttcttctcggactgagaagcgtgatcaatttgattggagcaagaaggatagggttgagccagccacacccgtcgcggtttgtaagaataagaagatccttctctcacatcgctattcccgaggtttggtaaagtacgatcccctaacaaaatctatcgattttttttccggacatcctaccgcttacagaaaagttatttattttcaaagtttgatatctcatctataa

SEQ ID NO: 1066 - protein, 435 aa, Arabidopsis thaliana
MKDAEKREVIASSSLQRKRNRGRRLRKRRRRNEKRVLMVPSSLPNDVLEEIFLRFPVKALIRLKSLSKQWRSTIESRSFEERHLTIAKKAFVDHPKVMLVGEEDPIRGTGIRPDTDIGFRLFCLESASLLSFTRLNFPQGFFNWIYISESCDGLFCIHSPKSHSVYVVNPATRWLRLLPPAGFQILIHKFNPTEREWNVVMKSIFHLAFVKATDYKLVWLYNCDKYIVDASSPNVGVTKCEIFDFRKNAWRYLACTPSHQIFYYQKPASANGSVYWFTEPYNERIEVVAFDIQTETFRLLPKINPAIAGSDPHHIDMCTLDNSLCMSKREKDTMIQDIWRLKPSEDTWEKIFSIDLVSCPSSRTEKRDQFDWSKKDRVEPATPVAVCKNKKILLSHRYSRGLVKYDPLTKSIDFFSGHPTAYRKVIYFQSLISHL

SEQ ID NO: 1067 - DNA, 1471 bp, Arabidopsis thaliana
attcacaaaaaccggaaaaaaaaaaagacaagtaaagaaagctttgttcagtttacttcaatggaagcaaaacccttagcatcatcatcatctgaaccaaacatgatttctccatcatcaaacattaaaccaaaattaaaagatgaagattatatggagctggtgtgtgaaaatgggcagattcttgcaaagattcgaagaccaaagaacaacggttcttttcaaaagcaacgtaggcaatctctcctggatttgtatgagaccgagtacagcgagggtttcaagaaaaacatcaagattcttggagacacacaagttgttccggtgagtcagtctaagccacaacaagataaagaaaccaatgaacaaatgaacaacaataagaagaagctaaagtcctccaaaatcgaatttgagagaaatgtttcgaaaagcaacaaatgtgttgaatcatcaacattaattgatgtttctgctaaaggtccaaagaatgttgaagttactacagctcctcctgatgagcaatctgcagctgttggtagatccacggaattgtattttgcttcttcatcgaagttttctcgaggaacttcgagagatctaagttgttgttctttaaagaggaagtatggagatattgaagaagaagaatcaacctatttaagtaataattcagatgatgaatcagatgatgcgaagacacaagttcatgcgagaacaagaaagccggtgactaaaagaaaacgaagcacagaagtccataagttatatgaaagaaaacgaagagatgaattcaacaagaaaatgcgtgctttgcaggacctactaccaaattgttacaaggatgataaggcttcattgttggatgaggctatcaaatatatgcggacccttcaacttcaagttcagatgatgagtatgggaaatggattaataagaccacctacgatgttgccaatgggtcattactctcccatgggtctaggaatgcatatgggtgcagcagcaacaccaacatcaataccgcaattcctgcctatgaatgttcaagcaaccggttttccggggatgaacaatgcaccaccacaaatgctaagctttcttaatcacccaagtggactaattccaaacactcctatcttttctccattggaaaattgctctcagccattcgtggtgccttcgtgtgtttctcagactcaggctacttcttttactcaattcccaaagtctgcgtccgcctcaaacttagaagatgcaatgcaatatagaggaagcaacggttttagttattatcgctcgccaaactaatgatttgtagaaagttgatgttttctccaactaactaactttaagcaaaaaaaaatgatcgtctactctgtgttgttagtctatgggcttttgggccttgattcttggaacgatttgaacttaattccaactattttcaaagtggatgtacaaagtaaaa

SEQ ID NO: 1068 - protein, 416 aa, Arabidopsis thaliana
MEAKPLASSSSEPNMISPSSNIKPKLKDEDYMELVCENGQILAKIRRPKNNGSFQKQRRQSLLDLYETEYSEGFKKNIKILGDTQVVPVSQSKPQQDKETNEQMNNNKKKLKSSKIEFERNVSKSNKCVESSTLIDVSAKGPKNVEVTTAPPDEQSAAVGRSTELYFASSSKFSRGTSRDLSCCSLKRKYGDIEEEESTYLSNNSDDESDDAKTQVHARTRKPVTKRKRSTEVHKLYERKRRDEFNKKMRALQDLLPNCYKDDKASLLDEAIKYMRTLQLQVQMMSMGNGLIRPPTMLPMGHYSPMGLGMHMGAAATPTSIPQFLPMNVQATGFPGMNNAPPQMLSFLNHPSGLIPNTPIFSPLENCSQPFVVPSCVSQTQATSFTQFPKSASASNLEDAMQYRGSNGFSYYRSPN

SEQ ID NO: 1069 - DNA, 1065 bp, Arabidopsis thaliana
gtctctcattttcataattccattttcaggattgtctctcaatcttttattcttctcattcaccggtaatggcaaaagtctctgggaggagcaagaaaacaatcgttgacgatgaaatcagcgataaaacagcgtctgcgtctgagtctgcgtccattgccttaacatccaaacgcaaacgtaagtcgccgcctcgaaacgctcctcttcaacgcagctccccttacagaggcgtcacaaggcatagatggactgggagatacgaagcgcatttgtgggataagaacagctggaacgatacacagaccaagaaaggacgtcaagtttatctaggggcttacgacgaagaagaagcagcagcacgtgcctacgacttagcagcattgaagtactggggacgagacacactcttgaacttccctttgccgagttatgacgaagacgtcaaagaaatggaaggccaatccaaggaagagtatattggatcattgagaagaaaaagtagtggattttctcgcggtgtatcaaaatacagaggcgttgcaaggcatcaccataatgggagatgggaagctagaattggaagggtgtttggtaataaatatctatatcttggaacatacgccacgcaagaagaagcagcaatcgcctacgacatcgcggcaatagagtaccgtggacttaacgccgttaccaatttcgacgtcagccgttatctaaaccctaacgccgccgcggataaagccgattccgattctaagcccattcgaagccctagtcgcgagcccgaatcgtcggatgataacaaatctccgaaatcagaggaagtaatcgaaccatctacatcgccggaagtgattccaactcgccggagcttccccgacgatatccagacgtattttgggtgtcaagattccggcaagttagcgactgaggaagacgtaatattcgattgtttcaattcttatataaatcctggcttctataacgagtttgattatggaccttaatcgtattttctacaagttttgttttgattatctacacaatacatcaatatattct

SEQ ID NO: 1070 - protein, 313 aa, Arabidopsis thaliana
MAKVSGRSKKTIVDDEISDKTASASESASIALTSKRKRKSPPRNAPLQRSSPYRGVTRHRWTGRYEAHLWDKNSWNDTQTKKGRQVYLGAYDEEEAAARAYDLAALKYWGRDTLLNFPLPSYDEDVKEMEGQSKEEYIGSLRRKSSGFSRGVSKYRGVARHHHNGRWEARIGRVFGNKYLYLGTYATQEEAAIAYDIAAIEYRGLNAVTNFDVSRYLNPNAAADKADSDSKPIRSPSREPESSDDNKSPKSEEVIEPSTSPEVIPTRRSFPDDIQTYFGCQDSGKLATEEDVIFDCFNSYINPGFYNEFDYGP

SEQ ID NO: 1071 - DNA, 1110 bp, Arabidopsis thaliana
atgactcgtcggtgttcgcattgtagcaacaatgggcacaattcacgcacgtgtccaacgcgtgggtctggttcctcctccgccgtgaagttatttggtgtgaggttaacggatggctcgattattaaaaagagtgcgagtatgggtaatctctcggcattggctgttgcggcggcggcggcaacgcaccaccgtttatctccgtcgtctcctctggcgacgtcaaatcttaatgattcgccgttatcggatcatgcccgatactctaatttgcatcataatgaagggtatttatctgatgatcctgctcatggttctgggtctagtcaccgtcgtggtgagaggaagagaggtgttccttggactgaagaggaacatagactattcttagtcggtcttcagaaactcgggaaaggagattggcgcggtatttcgagaaactatgtaacgtcaagaactcctacacaagtggctagtcatgctcaaaagtattttattcgacatactagttcaagccgcaggaaaagacggtctagcctcttcgacatggttacagatgagatggtaaccgattcatcgccaacacaggaagagcagaccttaaacggttcctctccaagcaaggaacctgaaaagaaaagctaccttccttcacttgagctctcactcaataataccacagaagctgaagaggtcgtagccacggcgccacgacaggaaaaatctcaagaagctatagaaccatcaaatggtgtttcaccaatgctagtcccgggtggcttctttcctccttgttttccagtgacttacacgatttggctccctgcgtcacttcacggaacagaacatgccttaaacgctgagacttcttctcagcagcatcaggtcctaaaaccaaaacctggatttgctaaagaacgtgtgaacatggacgagttggtcggtatgtctcagcttagcataggaatggcgacaagacacgaaaccgaaacttccccttccccgctatctttgagactagagccctcaaggccatcagcgtttcactcgaatggctcggttaatggtgcagatttgagtaaaggcaacagcgcgattcaggctatctaa

SEQ ID NO: 1072 - protein, 369 aa, Arabidopsis thaliana
MTRRCSHCSNNGHNSRTCPTRGSGSSSAVKLFGVRLTDGSIIKKSASMGNLSALAVAAAAATHHRLSPSSPLATSNLNDSPLSDHARYSNLHHNEGYLSDDPAHGSGSSHRRGERKRGVPWTEEEHRLFLVGLQKLGKGDWRGISRNYVTSRTPTQVASHAQKYFIRHTSSSRRKRRSSLFDMVTDEMVTDSSPTQEEQTLNGSSPSKEPEKKSYLPSLELSLNNTTEAEEVVATAPRQEKSQEAIEPSNGVSPMLVPGGFFPPCFPVTYTIWLPASLHGTEHALNAETSSQQHQVLKPKPGFAKERVNMDELVGMSQLSIGMATRHETETSPSPLSLRLEPSRPSAFHSNGSVNGADLSKGNSAIQAI

SEQ ID NO: 1073 - DNA, 420 bp, Arabidopsis thaliana
atgctagatcacagtgaaaaggtcttattggttgattcagaaaccatgaaaacaagagctgaagatatgatcgaacagaacaacactagtgttaacgacaagaagaagacttgtgctgattgtggaaccagtaaaactcctctttggcgtggtggtcctgttggtccaaagtcgttgtgtaacgcgtgtgggatcagaaacagaaagaagagaagaggaggaacagaagataataagaaattaaagaaatcgagttctggcggcggaaaccgtaaatttggtgaatcgttaaaacagagtttgatggatttggggataaggaagagatcaacggtggagaagcaacgacagaagcttggtgaagaagaacaagccgctgtgttactcatggctctttcttatggctctgtttacgcttag

SEQ ID NO: 1074 - protein, 139 aa, Arabidopsis thaliana
MLDHSEKVLLVDSETMKTRAEDMIEQNNTSVNDKKKTCADCGTSKTPLWRGGPVGPKSLCNACGIRNRKKRRGGTEDNKKLKKSSSGGGNRKFGESLKQSLMDLGIRKRSTVEKQRQKLGEEEQAAVLLMALSYGSVYA

SEQ ID NO: 1075 - DNA, 1828 bp, Arabidopsis thaliana
gagagctaataaaaaatttatcaaagaagactaatatggagaaggacgatttcttgaggagtggtcatggaagagaagaaagccatgatgagatgagaaaacttgattcatctcacgatgattctcatcaagaacacgaccatattataagatccaagttggactcaactaaagtcgaaatggatgaggctaaagaggaaaatcgaagactaaagtcatcattgagtaaaatcaagaaagattttgacatccttcaaacacaatacaaccaattaatggccaaacataacgaaccaaccaagttccaatcaaaagggcatcatcaagacaaaggcgaagatgaagacagagaaaaagttaacgaacgtgaagaacttgtctcgttgagcctaggcagacggttaaattcagaggttccaagtggttcgaataaagaagaaaaaaataaagatgttgaagaagcggaaggtgacagaaattatgatgataatgaaaaaagcagtattcaagggttgagtatggggattgaatacaaggctttgagtaatcctaatgagaagttagagattgatcataatcaagaaaccatgtcgttggagattagtaacaataataagatcagatcacaaaatagttttgggtttaagaatgatggagatgatcatgaagatgaagatgagattttgcctcaaaaccttgttaagaaaactagggtttcggtgagatcaagatgtgagacaccaacgatgaacgacggatgtcaatggaggaaatatggccagaaaatagctaaaggcaatccatgtccccgagcttactatcgttgcaccattgcagcttcttgtccagtaagaaaacaggtgcaaagatgttcagaagatatgtctatacttatctcaacgtacgaaggaacacataaccatccacttcccatgtcagcaactgccatggcctctgccacttccgctgccgcctccatgcttctctccggcgcctcctcctcctcatccgccgcagctgatcttcatggccttaacttctctctttccggcaacaacatcactccaaaacctaaaactcatttcctccaatccccttcttcttctggccatccgaccgtcactctcgacctcacaacctcctcctcgtcgcagcaaccgttcttatcaatgctcaatagattcagctctcctccaagtaatgtctcacgatctaatagttatccttcaaccaatctcaacttttcaaacaacaccaacacattgatgaattggggtggtggtggtaatcccagtgatcaataccgtgcagcttacggcaacattaacacccatcagcaatcaccttaccacaaaatcattcaaacccgaaccgccgggtcatctttcgatccgtttggaagatcatcttcatcacattctccacaaataaatcttgatcatatcggaatcaagaacatcatcagtcaccaagtgccatctttaccggctgaaacaatcaaggcaatcacgacagatccaagtttccaatcggctttggcgacagctctatcttccatcatgggcggcgatttaaagattgatcacaatgtgactagaaatgaagctgagaagagcccttaaagagaattgttatatatatgttcttatatactcagtacattggtaaatgggtttagactttcactagtttcctagttcatctatatattggttgtttaatcacaagtttattttgttgttggagtttatggaactaatgtgtacatatgaaactttagaacgaataaataaaacttggaattcctttttaaaaaaaaaaaaaaaaa

SEQ ID NO: 1076 - protein, 528 aa, Arabidopsis thaliana
MEKDDFLRSGHGREESHDEMRKLDSSHDDSHQEHDHIIRSKLDSTKVEMDEAKEENRRLKSSLSKIKKDFDILQTQYNQLMAKHNEPTKFQSKGHHQDKGEDEDREKVNEREELVSLSLGRRLNSEVPSGSNKEEKNKDVEEAEGDRNYDDNEKSSIQGLSMGIEYKALSNPNEKLEIDHNQETMSLEISNNNKIRSQNSFGFKNDGDDHEDEDEILPQNLVKKTRVSVRSRCETPTMNDGCQWRKYGQKIAKGNPCPRAYYRCTIAASCPVRKQVQRCSEDMSILISTYEGTHNHPLPMSATAMASATSAAASMLLSGASSSSSAAADLHGLNFSLSGNNITPKPKTHFLQSPSSSGHPTVTLDLTTSSSSQQPFLSMLNRFSSPPSNVSRSNSYPSTNLNFSNNTNTLMNWGGGGNPSDQYRAAYGNINTHQQSPYHKIIQTRTAGSSFDPFGRSSSSHSPQINLDHIGIKNIISHQVPSLPAETIKAITTDPSFQSALATALSSIMGGDLKIDHNVTRNEAEKSP

SEQ ID NO: 1077 - DNA, 1002 bp, Arabidopsis thaliana
tcgaccaatttagaccattccaaattcgtcgtccttttctctgtgtagtctaattatatattacaagtagatgaattggttacctgaagctgaagctgaggagcacttgaaaggtattctctctggtgatttctttgatggtctcaccaatcaccttgattgcccacttgaagacatcgattccaccaatggtgagggagattgggtcgccaggtttcaagaccttgagcctcctcccttggatatgttccctgctttgccttctgacctcacctcttgtcccaagggcgccgctcgtgtgcggattcccaacaacatgattcctgctttgaagcagtcctgttcttctgaagccttgtccggcattaatagcactccccaccaatcttcagctcctcctgatatcaaagtttcatatctatttcagtctctaactccagtgtcagttctcgagaacagttatggttctctctccacccaaaactccggatctcagagattggctttccctgtgaaaggcatgagaagcaagcgcagacgccccacaacagtgagacttagctaccttttcccctttgaacccagaaagtcaactccgggtgaatcagtaaccgagggttactattcttctgagcaacatgccaagaagaagcgcaagattcatctgatcacccacaccgagtcttccactttggagtcaagtaagtcggatgggatagtccggatatgcactcattgtgagacaatcacgaccccacagtggaggcaaggacccagtggacccaagaccctctgcaacgcttgcggagtccggttcaaatctggtcgcctagttccagaataccggccagcctcaagcccgaccttcatcccatctgtgcattcaaactcacacaggaagatcattgagatgagaaagaaggacgacgagtttgataccagcatgattcgcagtgatatccagaaggtaaagcaggggaggaagaaaatggtataaaagta

SEQ ID NO: 1078 - protein, 308 aa, Arabidopsis thaliana
MNWLPEAEAEEHLKGILSGDFFDGLTNHLDCPLEDIDSTNGEGDWVARFQDLEPPPLDMFPALPSDLTSCPKGAARVRIPNNMIPALKQSCSSEALSGINSTPHQSSAPPDIKVSYLFQSLTPVSVLENSYGSLSTQNSGSQRLAFPVKGMRSKRRRPTTVRLSYLFPFEPRKSTPGESVTEGYYSSEQHAKKKRKIHLITHTESSTLESSKSDGIVRICTHCETITTPQWRQGPSGPKTLCNACGVRFKSGRLVPEYRPASSPTFIPSVHSNSHRKIIEMRKKDDEFDTSMIRSDIQKVKQGRKKMV

SEQ ID NO: 1079 - DNA, 1291 bp, Arabidopsis thaliana
cctgtaaattcagatttgctttctttggtaatcttttggatcaagatccatctattttttcttcaatggcacaactccctcctaaaatccccaacatgacacaacattggcctgatttctcttcccaaaagctctctcctttctctaccccaaccgcaaccgctgtcgccaccgctacaaccaccgtacaaaacccctcatgggtcgacgaattcctcgacttctcagcgtctcgccgtggcaaccaccgtcgttccatcagcgactctatcgcattcctcgaagctccaacagtcagcatcgaagaccaccaattcgacaggttcgatgacgaacagttcatgtcgatgttcaccgacgacgacaaccttcatagcaatccttcccatatcaacaacaaaaataacaatgtggggcccacgggatcttcctcgaacacatccacgccgtccaatagcttcaacgacgataacaaagaattaccaccgtccgatcataacatgaacaataatatcaacaacaactataacgatgaagtccaaagccaatgcaagatggagccagaagatggtacggcgtcgaataacaattccggtgatagctccggcaaccggattctcgatcccaaaagggttaagagaatattagcaaatcggcaatcagcacagagatcaagggtgaggaaactgcaatacatatcagagctcgaacgtagcgtcacttcgttgcaggcggaagtgtcagtgttatcgccaagagttgcattcttggatcatcaacgtttgcttcttaacgttgacaacagcgctctcaagcaacgaatcgctgctttatctcaagacaagcttttcaaagacgcacatcaagaagcattgaagagagaaatagagagacttcgacaagtgtataatcaacaaagcctcacgaatgtggaaaatgcaaatcatttatcggcgaccggagccggtgctactccggccgtcgacatcaagtcgtccgttgaaacagagcagctcctcaatgtctcataaattaaccatcatgcatcatcatcaacatttctctcttttagcttcttggcaaaagttcttgactataaaatctctttcgggtaagaaattcaggagatatacattttttattctaatcacattgtttttaagttgtgatgaattcagtttgatgtatcttatttattttgtttatgtcgtctttttttcttggggttgatggaagggaatcatcaattgttgtttgtacaaagaactagttgaatttttttttttttttt

SEQ ID NO: 1080 - protein, 321 aa, Arabidopsis thaliana
MAQLPPKIPNMTQHWPDFSSQKLSPFSTPTATAVATATTTVQNPSWVDEFLDFSASRRGNHRRSISDSIAFLEAPTVSIEDHQFDRFDDEQFMSMFTDDDNLHSNPSHINNKNNNVGPTGSSSNTSTPSNSFNDDNKELPPSDHNMNNNINNNYNDEVQSQCKMEPEDGTASNNNSGDSSGNRILDPKRVKRILANRQSAQRSRVRKLQYISELERSVTSLQAEVSVLSPRVAFLDHQRLLLNVDNSALKQRIAALSQDKLFKDAHQEALKREIERLRQVYNQQSLTNVENANHLSATGAGATPAVDIKSSVETEQLLNVS

SEQ ID NO: 1081 - DNA, 1304 bp, Arabidopsis thaliana
tgatcatctaaaactttcaatttctctcttgatcctcacttgaattttttgttgtttctctcaaatctttgatcctttcctttgtttttcatttgacctcttacaaaaaaatctggtgtgccattaaatctttattaatggcacaacttcctccgaaaatcccaaccatgacgacgccaaattggcctgacttctcctcccagaaactcccttccatagccgcaacggcggcagccgcagcaaccgctggacctcaacaacaaaacccttcatggatggatgagtttctcgacttctcagcgactcgccgtgggactcaccgtcgttctataagcgactccattgctttccttgaaccaccttcctccggcgtcggaaaccaccacttcgataggtttgacgacgagcaattcatgtccatgttcaacgacgacgtacacaacaataaccacaatcatcatcatcatcacagcatcaacggcaatgtgggtcccacgcgttcatcctccaacacctccacgccgtccgatcataatagccttagcgacgacgacaacaacaaagaagcaccaccgtccgatcatgatcatcacatggacaataatgtagccaatcaaaacaacgccgccggtaacaattacaacgaatcagacgaggtccaaagccagtgcaagacggagccacaagatggtccgtcggcgaatcaaaactccggtggaagctccggtaatcgtattcacgaccctaaaagggtaaaaagaattttagcaaataggcaatcagcacagagatcaagggtgaggaaattgcaatacatatcagagcttgaaaggagcgttacttcattgcagactgaagtgtcagtgttatcgccaagagttgcgtttttggatcatcagcgattgcttctcaacgtcgacaatagtgctatcaagcaacgaatcgcagctttagcacaagataagattttcaaagacgctcatcaagaagcattgaagagagaaatagagagacttcgacaagtatatcatcaacaaagcctcaagaagatggagaataatgtctccgatcaatctccggccgatatcaaaccgtccgttgagaaggaacagctcctcaatgtctaaagctgttcgttcactaagatctttcttttcatggcgaaaagattcttgactataaaacctctttgtgtcaagaaattaatttatcaaagaagatggccttttttatttgatctaatcacatttttttaagttgtgatgaatttgcttttgatgtatctgtttttttttttttttttt

SEQ ID NO: 1082 - protein, 329 aa, Arabidopsis thaliana
MAQLPPKIPTMTTPNWPDFSSQKLPSIAATAAAAATAGPQQQNPSWMDEFLDFSATRRGTHRRSISDSIAFLEPPSSGVGNHHFDRFDDEQFMSMFNDDVHNNNHNHHHHHSINGNVGPTRSSSNTSTPSDHNSLSDDDNNKEAPPSDHDHHMDNNVANQNNAAGNNYNESDEVQSQCKTEPQDGPSANQNSGGSSGNRIHDPKRVKRILANRQSAQRSRVRKLQYISELERSVTSLQTEVSVLSPRVAFLDHQRLLLNVDNSAIKQRIAALAQDKIFKDAHQEALKREIERLRQVYHQQSLKKMENNVSDQSPADIKPSVEKEQLLNV

SEQ ID NO: 1083 - DNA, 1995 bp, Arabidopsis thaliana
atgggttgtgctgcttcaagaattgataatgaagaaaaggttttagtgtgtaggcagagaaagaggctaatgaaaaagttattagggttcaggggagaatttgcagatgcacagttggcttatcttagagctttgaggaacactggtgttactcttaggcaattcactgagtctgagaccttggagcttgaaaacactagttatggtttaagtttgcctttgcctccttcgcctcctcctacattgcctccttcacctccaccacctcctccatttagcccggatttgagaaatcctgagactagtcatgacttggctgatgaggaggaagagggtgaaaatgatggtggtaatgatggaagtggtgcagctcctccgcctccattgccgaattcttggaacatttggaacccttttgagtcacttgagctgcatagtcatccaaatggtgacaatgtagttacacaagttgaactgaagaagaaacaacaaattcagcaagctgaagaggaagattgggcggagacgaagtctcaatttgaggaagaagatgagcaacaagaagcaggaggtacttgccttgatttgagtgttcatcaaatagaggctgttagtggctgtaacatgaagaagccacgtcgtctgaagtttaagctgggagaagttatggacggtaactcatctatgacaagctgctccggtaaagatcttgagaaaactcatgtgactgattgtagaatcaggaggaccttagaaggaatcatcagagagttggatgattattttcttaaagcatcgggttgcgagaaggagatagctgtgatagtagacatcaacagtagggatactgttgatcctttcaggtaccaggaaacaagaaggaagagaagcagctcggcaaaggtattcagtgcattgtcatggagttggtcttcaaagtctcttcagttgggcaaagatgctacaacaagcgggactgttgaaccctgtaggcctggagctcactgcagcacacttgagaagctatacacagctgagaagaaactttaccagctagtcagaaacaaagagattgccaaagtggagcatgagaggaagtctgcattactgcaaaagcaagatggggaaacctatgatttgagcaaaatggagaaagcacgcttgtctttggagagtttggaaaccgagatacagcgtctagaagattccataactacaacacgctcatgtttgcttaacttgatcaatgatgagctgtatccgcagctagttgctttaacttcagggctagcacagatgtggaaaacaatgctcaagtgtcatcaagttcaaattcatatatcccagcaactgaaccatcttccggattacccgagtatagatctcagttcggaatacaaacgccaggcggttaatgaactagagaccgaggttacttgctggtacaatagcttttgcaagttagtaaattcccagcgagaatacgtgaaaacactctgtacgtggatccaacttactgatcgcctctctaacgaagacaaccaaagaagtagcttgcctgttgctgctcgtaagctctgcaaagagtggcagcttgaatacaacctgcgtaggaaatgcaataaacttgagaggaggcttgagaaagagctaatttcactggctgagattgaaagaaggctcgaggggattttagcaatggaagaggaggaagtaagctcaacgagtttgggctctaagcatccgttgtcaatcaaacaagccaagatcgaagccttgagaaaacgagtggatattgagaaaactaagtacttaaactcggtcgaggttagtaagagaatgacactagacaacctcaaatcaagccttcccaatgtctttcagatgttgactgctctagctaatgtctttgccaatgggtttgaatccgttaatggccaaaccggtacagatgtttccgacacatcccaacattccgatgaatctcaaccctaa

SEQ ID NO: 1084 - protein, 664 aa, Arabidopsis thaliana
MGCAASRIDNEEKVLVCRQRKRLMKKLLGFRGEFADAQLAYLRALRNTGVTLRQFTESETLELENTSYGLSLPLPPSPPPTLPPSPPPPPPFSPDLRNPETSHDLADEEEEGENDGGNDGSGAAPPPPLPNSWNIWNPFESLELHSHPNGDNVVTQVELKKKQQIQQAEEEDWAETKSQFEEEDEQQEAGGTCLDLSVHQIEAVSGCNMKKPRRLKFKLGEVMDGNSSMTSCSGKDLEKTHVTDCRIRRTLEGIIRELDDYFLKASGCEKEIAVIVDINSRDTVDPFRYQETRRKRSSSAKVFSALSWSWSSKSLQLGKDATTSGTVEPCRPGAHCSTLEKLYTAEKKLYQLVRNKEIAKVEHERKSALLQKQDGETYDLSKMEKARLSLESLETEIQRLEDSITTTRSCLLNLINDELYPQLVALTSGLAQMWKTMLKCHQVQIHISQQLNHLPDYPSIDLSSEYKRQAVNELETEVTCWYNSFCKLVNSQREYVKTLCTWIQLTDRLSNEDNQRSSLPVAARKLCKEWQLEYNLRRKCNKLERRLEKELISLAEIERRLEGILAMEEEEVSSTSLGSKHPLSIKQAKIEALRKRVDIEKTKYLNSVEVSKRMTLDNLKSSLPNVFQMLTALANVFANGFESVNGQTGTDVSDTSQHSDESQP

SEQ ID NO: 1085 - DNA, 965 bp, Arabidopsis thaliana
tttttttttaaaagatttagagagaaaagtgagttattaagagattccaatcaaaatgagcggagacaacggcggtggtgagaggcgcaaaggctccgtcaagtggtttgatacccagaagggtttcggcttcatcactcctgacgacggtggcgacgatctcttcgttcaccagtcctccatcagatctgagggtttccgtagcctcgctgccgaagaagccgtagagttcgaggttgagatcgacaacaacaaccgtcccaaggccatcgatgtttctggacccgacggcgctcccgtccaaggaaacagcggtggtggttcatctggcggacgcggcggtttcggtggaggaagaggaggtggacgcggatctggaggtggatacggcggtggcggtggtggatacggaggaagaggaggtggtggtcgaggaggcagcgactgctacaagtgtggtgagcccggtcacatggcgagagactgttctgaaggcggtggaggttacggaggaggcggcggtggctacggaggtggaggcggatacggcggaggaggtggtggttacggaggtggtggccgtggaggtggtggcggcgggggaagctgctacagctgtggcgagtcgggacatttcgccagggattgcaccagcggtggacgttaaaaccaacgccggttacgcggtggagaagagtgagttggttatctcacaagtgatcggttctttctcccgccgccttctatctctctattatccactttttgcttattatgatggatctctatctttgttagttggttttttcttgatggtttcggattaggactcttcttttggttttgctacttatggttggttttatttatggtacttgtgatatgggtgaaatgctctacttgttgctctgtttcaagtgttcataatatgcgaacaaatattctgggttttgtttcaaaaaaaa

SEQ ID NO: 1086 - protein, 203 aa, Arabidopsis thaliana
MSGDNGGGERRKGSVKWFDTQKGFGFITPDDGGDDLFVHQSSIRSEGFRSLAAEEAVEFEVEIDNNNRPKAIDVSGPDGAPVQGNSGGGSSGGRGGFGGGRGGGRGSGGGYGGGGGGYGGRGGGGRGGSDCYKCGEPGHMARDCSEGGGGYGGGGGGYGGGGGYGGGGGGYGGGGRGGGGGGGSCYSCGESGHFARDCTSGGR

SEQ ID NO: 1087 - DNA, 883 bp, Arabidopsis thaliana
gggcataacccttatcggagatttgaagccatgggaagaagaaaaatcgagatcaagcgaatcgagaacaaaagcagtcgacaagtcactttctccaaacgacgcaatggtctcatcgacaaagctcgacaactttcgattctctgtgaatcctccgtcgctgttgtcgtcgtatctgcctccggaaaactctatgactcttcctccggtgacgacatttccaagatcattgatcgttatgaaatacaacatgctgatgaacttagagccttagatcttgaagaaaaaattcagaattatcttccacacaaggagttactagaaacagtccaaagcaagcttgaagaaccaaatgtcgataatgtaagtgtagattctctaatttctctggaggaacaacttgagactgctctgtccgtaagtagagctaggaaggcagaactgatgatggagtatatcgagtcccttaaagaaaaggagaaattgctgagagaagagaaccaggttctggctagccagatgggaaagaatacgttgctggcaacagatgatgagagaggaatgtttccgggaagtagctccggcaacaaaataccggagactctcccgctgctcaattagccaccatcatcaacggctgagttttcaccttaaactcaaagcctgattcataattaagagaataaatttgtatattataaaaagctgtgtaatctcaaaccttttatcttcctctagtgtggaatttaaggtcaaaaagaaaacgagaaagtatggatcagtgttgtacctccttcggagacaagatcagagtttgtgtgtttgtgtctgaatgtacggattggatttttaaagttgtgctttctttcttcaaaaaaaaaaa

SEQ ID NO: 1088 - protein, 196 aa, Arabidopsis thaliana
MGRRKIEIKRIENKSSRQVTFSKRRNGLIDKARQLSILCESSVAVVVVSASGKLYDSSSGDDISKIIDRYEIQHADELRALDLEEKIQNYLPHKELLETVQSKLEEPNVDNVSVDSLISLEEQLETALSVSRARKAELMMEYIESLKEKEKLLREENQVLASQMGKNTLLATDDERGMFPGSSSGNKIPETLPLLN

SEQ ID NO: 1089 - DNA, 954 bp, Arabidopsis thaliana
atgaataaccaatctgttactgacaatacaagtcttaagctgtcatctaatcttaacaacgagtcaaaagaaacatctgagaacagtgatgaccaacacagcgagatcacaacaattacatcggaagaagagaaaacaactgaactgaagaaaccagacaagattcttccatgtccgagatgcaacagcgcagacaccaaattctgttactacaacaactacaacgttaaccagccacgtcacttctgtagaaaatgccagaggtattggaccgctggtggatccatgaggatcgtcccggttggctcaggccgtcgcaagaacaagggatgggtttcttcagaccagtacctgcacatcacttccgaggatactgacaattacaatagctcctcaacaaagattctaagcttcgagtcttcggactctttggtaactgagaggcctaagcatcaatcaaacgaagtgaagataaacgctgaacctgtttcacaagaacccaacaacttccaagggttacttcctccccaagcatcccctgtttcgcctccttggccttaccaataccctccaaaccctagtttctaccacatgcccgtctactggggctgcgcgataccggtttggtctaccctcgacacttctacatgtcttgggaaaaggacaagagacgaaacttctcatgaaactgttaaagagagtaaaaatgcttttgagagaacaagcttgcttttggaatctcagagcatcaaaaatgaaacaagtatggctacaaataaccatgtgtggtatccagtaccgatgacccgcgagaagacacaagaattcagctttttcagtaatggagctgaaacaaagagcagcaacaacagattcgtccctgaaacgtatcttaacctgcaagcaaaccctgcagccatggcaagatctatgaacttcagagagagcatataa

SEQ ID NO: 1090 - protein, 317 aa, Arabidopsis thaliana
MNNQSVTDNTSLKLSSNLNNESKETSENSDDQHSEITTITSEEEKTTELKKPDKILPCPRCNSADTKFCYYNNYNVNQPRHFCRKCQRYWTAGGSMRIVPVGSGRRKNKGWVSSDQYLHITSEDTDNYNSSSTKILSFESSDSLVTERPKHQSNEVKINAEPVSQEPNNFQGLLPPQASPVSPPWPYQYPPNPSFYHMPVYWGCAIPVWSTLDTSTCLGKRTRDETSHETVKESKNAFERTSLLLESQSIKNETSMATNNHVWYPVPMTREKTQEFSFFSNGAETKSSNNRFVPETYLNLQANPAAMARSMNFRESI

SEQ ID NO: 1091 - DNA, 897 bp, Arabidopsis thaliana
atgctggaaactaaagatcctgcgataaagctctttggtatgaaaattcctttcccgacggttttagaggttgctgatgaagaagaagaaaagaaccaaaacaagacattaactgatcaatcggagaaagacaaaaccctaaagaaaccaaccaagattcttccatgtccaagatgcaacagcatggagactaagttctgttactacaacaactacaacgtaaaccaacctcgccatttttgtaaagcttgtcagagatattggacctcaggtgggaccatgagaagtgttccaatcggagcaggacggcgcaagaacaagaacaactcaccaacttcacattaccaccatgtgactatctccgaaacaaatggtccggtccttagtttcagcctcggagatgatcaaaaggtctcgagtaataggtttggtaatcaaaagctagttgctaggatagagaacaatgacgagcgctctaataacaacacttcgaacggtttgaattgttttccgggagtttcgtggccgtacacgtggaatcctgcgttttacccggtttacccttattggagcatgccagtgttgtcttctccggtaagttcaagtcctacttctactcttggtaagcattcgagagacgaagacgagacggtgaagcaaaaacagaggaatggatctgtattggttccaaagactttgagaattgatgatcctaatgaagctgcaaagagttcgatatggacaacacttgggatcaagaacgaagttatgttcaatgggtttggttcgaagaaagaggttaagctcagtaacaaagaagaaacagagacctcacttgttctttgtgcaaaccctgctgcgttatcaagatcaatcaatttccatgagcagatgtga

SEQ ID NO: 1092 - protein, 298 aa, Arabidopsis thaliana
MLETKDPAIKLFGMKIPFPTVLEVADEEEEKNQNKTLTDQSEKDKTLKKPTKILPCPRCNSMETKFCYYNNYNVNQPRHFCKACQRYWTSGGTMRSVPIGAGRRKNKNNSPTSHYHHVTISETNGPVLSFSLGDDQKVSSNRFGNQKLVARIENNDERSNNNTSNGLNCFPGVSWPYTWNPAFYPVYPYWSMPVLSSPVSSSPTSTLGKHSRDEDETVKQKQRNGSVLVPKTLRIDDPNEAAKSSIWTTLGIKNEVMFNGFGSKKEVKLSNKEETETSLVLCANPAALSRSINFHEQM

SEQ ID NO: 1093 - DNA, 861 bp, Arabidopsis thaliana
atgggaaggcagccatgttgtgacaagctcatggtgaagaaggggccgtggacggcggaggaagacaagaaactgataaactttatcttgaccaacggccactgttgctggagggctttgccgaagctggccggtctccgtcgctgtgggaagagctgccgtctacggtggaccaattatctccgacctgacttgaagagaggtcttctctccgacgccgaggaacagcttgtcatcgaccttcatgctcttctcggcaacagatggtccaagatcgctgcaagattaccaggaagaacagacaacgaaataaaaaatcattggaatactcatatcaagaagaagctccttaagatggaaatcgatccttcgacccatcaacctttaaacaaagtatttaccgatacaaacttagtcgataaatctgaaacttcatcgaaagccgacaatgtaaatgataataaaatcgtagagatcgatgggacaacgacaaatacaatagatgatagcattatcactcatcaaaatagttcaaatgatgattatgaattacttggtgatataattcataattatggagatttatttaatattctatggaccaacgatgaacctcctctagtcgatgatgcatcatggagcaatcataacgttggtattggaggaacagctgcagttgcagcctcagacaagaacaacactgctgccgaggaagatttcccggaaagatcatttgaaaaacagaacggcgaaagttggatgttcttggattattgccaagaatttggtgttgaagattttgggttcgagtgttaccatggttttggtcaaagctccatgaagacgggtcacaaggactag

SEQ ID NO: 1094 - protein, 286 aa, Arabidopsis thaliana
MGRQPCCDKLMVKKGPWTAEEDKKLINFILTNGHCCWRALPKLAGLRRCGKSCRLRWTNYLRPDLKRGLLSDAEEQLVIDLHALLGNRWSKIAARLPGRTDNEIKNHWNTHIKKKLLKMEIDPSTHQPLNKVFTDTNLVDKSETSSKADNVNDNKIVEIDGTTTNTIDDSIITHQNSSNDDYELLGDIIHNYGDLFNILWTNDEPPLVDDASWSNHNVGIGGTAAVAASDKNNTAAEEDFPERSFEKQNGESWMFLDYCQEFGVEDFGFECYHGFGQSSMKTGHKD

SEQ ID NO: 1095 - DNA, 2240 bp, Arabidopsis thaliana
tgagatttctccatttccgtagcttctggtctcttttctttgtttcattgatcaaaagcaaatcacttcttcttcttcttcttctcgatttcttactgttttcttatccaacgaaatctggaattaaaaatggaatctttatcgaatccaagctgattttgtttctttcattgaatcatctctctaaagtggaattttgtaaagagaagatctgaagttgtgtagaggagcttagtgatggagacaaattcgtctggagaagatctggttattaagactcggaagccatatacgataacaaagcaacgtgaaaggtggactgaggaagaacataatagattcattgaagctttgaggctttatggtagagcatggcagaagattgaagaacatgtagcaacaaaaactgctgtccagataagaagtcacgctcagaaatttttctccaaggtagagaaagaggctgaagctaaaggtgtagctatgggtcaagcgctagacatagctattcctcctccacggcctaagcgtaaaccaaacaatccttatcctcgaaagacgggaagtggaacgatccttatgtcaaaaacgggtgtgaatgatggaaaagagtcccttggatcagaaaaagtgtcgcatcctgagatggccaatgaagatcgacaacaatcaaagcctgaagagaaaactctgcaggaagacaactgttcagattgtttcactcatcagtatctctctgctgcatcctccatgaataaaagttgtatagagacatcaaacgcaagcactttccgcgagttcttgccttcacgggaagagggaagtcagaataacagggtaagaaaggagtcaaactcagatttgaatgcaaaatctctggaaaacggtaatgagcaaggacctcagacttatccgatgcatatccctgtgctagtgccattggggagctcaataacaagttctctatcacatcctccttcagagccagatagtcatccccacacagttgcaggagattatcagtcgtttcctaatcatataatgtcaacccttttacaaacaccggctctttatactgccgcaactttcgcctcatcattttggcctcccgattctagtggtggctcacctgttccagggaactcacctccgaatctggctgccatggccgcagccactgttgcagctgctagtgcttggtgggctgccaatggattattacctttatgtgctcctcttagttcaggtggtttcactagtcatcctccatctacttttggaccatcatgtgatgtagagtacacaaaagcaagcactttacaacatggttctgtgcagagccgagagcaagaacactccgaggcatcaaaggctcgatcttcactggactcagaggatgttgaaaataagagtaaaccagtttgtcatgagcagccttctgcaacacctgagagtgatgcaaagggttcagatggagcaggagacagaaaacaagttgaccggtcctcgtgtggctcaaacactccgtcgagtagtgatgatgttgaggcggatgcatcagaaaggcaagaggatggcaccaatggtgaggtgaaagaaacgaatgaagacactaataaacctcaaacttcagagtccaatgcacgccgcagtagaatcagctccaatataaccgatccatggaagtctgtgtctgacgagggtcgaattgccttccaagctctcttctccagagaggtattgccgcaaagttttacatatcgagaagaacacagagaggaagaacaacaacaacaagaacaaagatatccaatggcacttgatcttaacttcacagctcagttaacaccagttgatgatcaagaggagaagagaaacacaggatttcttggaatcggattagatgcttcaaagctaatgagtagaggaagaacaggttttaaaccatacaaaagatgttccatggaagccaaagaaagtagaatcctcaacaacaatcctatcattcatgtggaacagaaagatcccaaacggatgcggttggaaactcaagcttccacatgagactctattttcatctgatctgttgtttgtactctgtttttaagttttcaagaccactgctacattttctttttcttttgaggcctttgtatttgtttccttgtccatagtcttcctgtaacatttgactctgtattattcaacaaatcataaactgtttaatctttttttttcca

SEQ ID NO: 1096 - protein, 608 aa, Arabidopsis thaliana
METNSSGEDLVIKTRKPYTITKQRERWTEEEHNRFIEALRLYGRAWQKIEEHVATKTAVQIRSHAQKFFSKVEKEAEAKGVAMGQALDIAIPPPRPKRKPNNPYPRKTGSGTILMSKTGVNDGKESLGSEKVSHPEMANEDRQQSKPEEKTLQEDNCSDCFTHQYLSAASSMNKSCIETSNASTFREFLPSREEGSQNNRVRKESNSDLNAKSLENGNEQGPQTYPMHIPVLVPLGSSITSSLSHPPSEPDSHPHTVAGDYQSFPNHIMSTLLQTPALYTAATFASSFWPPDSSGGSPVPGNSPPNLAAMAAATVAAASAWWAANGLLPLCAPLSSGGFTSHPPSTFGPSCDVEYTKASTLQHGSVQSREQEHSEASKARSSLDSEDVENKSKPVCHEQPSATPESDAKGSDGAGDRKQVDRSSCGSNTPSSSDDVEADASERQEDGTNGEVKETNEDTNKPQTSESNARRSRISSNITDPWKSVSDEGRIAFQALFSREVLPQSFTYREEHREEEQQQQEQRYPMALDLNFTAQLTPVDDQEEKRNTGFLGIGLDASKLMSRGRTGFKPYKRCSMEAKESRILNNNPIIHVEQKDPKRMRLETQAST

SEQ ID NO: 1097 - DNA, 1050 bp, Arabidopsis thaliana
ctcatatataccaaccaaacctctctctgcatctttattaacacaaaattccaaaagattaaatgttgtcgaagctccctacacagcgacacttgcacctctctccctcctctccctccatggaaaccgtcgggcgtccacgtggcagacctcgaggttccaaaaacaaacctaaagctccaatctttgtcaccattgaccctcctatgagtccttacatcctcgaagtgccatccggaaacgatgtcgttgaagccctaaaccgtttctgccgcggtaaagccatcggcttttgcgtcctcagtggctcaggctccgttgctgatgtcactttgcgtcagccttctccggcagctcctggctcaaccattactttccacggaaagttcgatcttctctctgtctccgccactttcctccctcctctacctcctacctccttgtcccctcccgtctccaatttcttcaccgtctctctcgccggacctcaggggaaagtcatcggtggattcgtcgctggtcctctcgttgccgccggaactgtttacttcgtcgccactagtttcaagaacccttcctatcaccggttacctgctacggaggaagagcaaagaaactcggcggaaggggaagaggagggacaatcgccgccggtctctggaggtggtggagagtcgatgtacgtgggtggctctgatgtcatttgggatcccaacgccaaagctccatcgccgtactgaccacaaatccatctcgttcaaactagggtttcttcttctttagatcatcaagaatcaacaaaaagattgcatttttagattctttgtaatatcataattgactcactctttaatctctctatcacttcttctttagctttttctgcagtgtcaaacttcacatatttgtagtttgatttgactatccccaagttttgtattttatcatacaaatttttgcctgtctctaatggttgttttttcgtttgtataatcttatgcattgtttattggagctccagagattgaatgtataatataatggtttaat

SEQ ID NO: 1098 - protein, 225 aa, Arabidopsis thaliana
MLSKLPTQRHLHLSPSSPSMETVGRPRGRPRGSKNKPKAPIFVTIDPPMSPYILEVPSGNDVVEALNRFCRGKAIGFCVLSGSGSVADVTLRQPSPAAPGSTITFHGKFDLLSVSATFLPPLPPTSLSPPVSNFFTVSLAGPQGKVIGGFVAGPLVAAGTVYFVATSFKNPSYHRLPATEEEQRNSAEGEEEGQSPPVSGGGGESMYVGGSDVIWDPNAKAPSPY

SEQ ID NO: 1099 - DNA, 1139 bp, Arabidopsis thaliana
cacaacatcatacccaccaacatatataatcttgatcatagagagataaacagaggccgctatcaagaacaagactaagaacaagacttcactaggagtacaagtatgggaagagcaccgtgttgtgacaaagcaaacgtgaagaaagggccttggtctcctgaggaagatgcaaaactcaaatcttacattgaaaatagtggcaccggaggcaattggatcgctttgcctcaaaagattggtttaaagagatgtggaaagagttgcaggctgaggtggcttaactatcttagaccaaacatcaaacatggtggcttctctgaggaagaagaaaacatcatttgtagcctttaccttacaattggtagcaggtggtctataatcgctgctcaattgccgggacgaacagacaacgatataaaaaactattggaacacgaggctcaagaagaaactcattaacaaacaacgcaaggagcttcaagaagcttgtatggagcagcaagagatgatggtgatgatgaagagacaacaccaacaacaacaaatccaaacttcttttatgatgagacaagaccaaacaatgttcacatggccactacatcatcataatgttcaagttccagctcttttcagaatcaaaccaactcgttttgcgaccaagaagatgttaagccagtgctcatcaagaacatggtcaagatcgaagatcaagaactggagaaaacaaacctcatcatcatcaagattcaatgacaacgcttttgatcatctctctttctctcaactcttgttagatcctaatcataaccacttaggatcaggagagggtttctccatgaactctatcttgagcgccaacacaaactctccattgcttaacacaagtaatgataatcagtggttcgggaatttccaggccgaaaccgtaaacttgttctcaggagcctccacaagtacttcggcagatcaaagcactataagttgggaagacataagctctcttgtttattctgattcaaagcaatttttttaattataataatatattattcttaagatgaaacgtacatcattattattaattgggggtacgtaacgtatatatggaataacgatctagtttgtttaaatttaaaa

SEQ ID NO: 1100 - protein, 309 aa, Arabidopsis thaliana
MGRAPCCDKANVKKGPWSPEEDAKLKSYIENSGTGGNWIALPQKIGLKRCGKSCRLRWLNYLRPNIKHGGFSEEEENIICSLYLTIGSRWSIIAAQLPGRTDNDIKNYWNTRLKKKLINKQRKELQEACMEQQEMMVMMKRQHQQQQIQTSFMMRQDQTMFTWPLHHHNVQVPALFRIKPTRFATKKMLSQCSSRTWSRSKIKNWRKQTSSSSRFNDNAFDHLSFSQLLLDPNHNHLGSGEGFSMNSILSANTNSPLLNTSNDNQWFGNFQAETVNLFSGASTSTSADQSTISWEDISSLVYSDSKQFF

SEQ ID NO: 1101 - DNA, 922 bp, Arabidopsis thaliana
tctgtctctctctctctctttgtaaatatacatatatagataagctcacatatatggcgactgaaacatcttctttgaagctcttcggtataaacctacttgaaacgacgtcggttcaaaaccagtcatcggaaccaagacccggatccggatcaggatccgagtcacgtaagtacgagtgtcaatactgttgtagagagtttgctaactctcaagctcttggtggtcaccaaaacgctcacaagaaagagcgtcagcttcttaaacgtgcacagatgttagctactcgtggtttgccacgtcatcataattttcaccctcataccaatccgcttctctccgccttcgcgccgctgcctcacctcctctctcagccgcatcctccgccgcatatgatgctctctccttcttcttcgagttctaagtggctttacggtgaacacatgtcgtcacaaaacgccgttgggtactttcatggtggaaggggactttacggaggtggcatggagtctatggccggagaagtaaagactcatggtggttctttgccggagatgaggaggttcgccggagatagtgatcggagtagcggaattaagttagagaatggtattgggctggacctccatttaagccttgggccatgaatgattataattttggcccagtaaagatctgtaaaatactactaggatttcatttttatagagtatgtttttttccttaatttcggttgaaattggtgaatatttttatctcttacttaccaaatctcatatttctatgtatgcgtttgctttcactttttttttttatataattcttcttgtaaaaaatgcaatgtgagttttcttccctatcattctgtcaagctttggttcaattatttagtaatcgaataatataggaatagtgttgaaag

SEQ ID NO: 1102 - protein, 197 aa, Arabidopsis thaliana
MATETSSLKLFGINLLETTSVQNQSSEPRPGSGSGSESRKYECQYCCREFANSQALGGHQNAHKKERQLLKRAQMLATRGLPRHHNFHPHTNPLLSAFAPLPHLLSQPHPPPHMMLSPSSSSSKWLYGEHMSSQNAVGYFHGGRGLYGGGMESMAGEVKTHGGSLPEMRRFAGDSDRSSGIKLENGIGLDLHLSLGP

SEQ ID NO: 1103 - DNA, 1554 bp, Arabidopsis thaliana
atttgaatttctgggtttctctctgtttaagcttcttcttcttcatcttctgcttacgtttcttcttcaaggagctttcggattcttgtagaaagagtcattgttctcttgagtgggaaaccttgaaaccattcctatgggaaatagcagcgaggaaccaaagcctcctaccaaatcagataaaccatcttcacccccggtggatcaaacaaatgttcatgtctaccctgattgggcagctatgcaggcatattatggtccaagagtagcaatgcctccttattacaattcagctatggctgcatctggtcatcctcctcctccttacatgtggaatcctcagcatatgatgtcaccatctggagcaccctatgctgctgtttatcctcatggaggaggagtttacgctcatcccggtattcccatgggatcactgcctcaaggtcaaaaggatccacctttaacaactccggggacgcttttgagcatcgacactcctactaaatctacagggaacacagacaatggattgatgaagaagctgaaagagtttgatgggcttgctatgtctctaggaaatgggaatcctgaaaatggtgcagatgaacataaacgatcacggaacagctcagaaactgatggttctactgatggaagtgatgggaatacaactggggcagatgaaccgaaacttaaaagaagtcgagagggaactccaacaaaagatgggaaacaattggttcaagctagctcatttcattctgtttctccgtcaagtggtgataccggcgtaaaactcattcaaggatctggagctatactctctcctggtgtaagtgcaaattccaaccccttcatgtcacaatctttagccatggttcctcctgaaacttggcttcagaacgagagagaactgaaacgggagcgaaggaaacagtctaatagagaatctgctagaaggtcaagattaaggaaacaggccgagacagaagaacttgctaggaaagtggaagccttgacagccgaaaacatggcattaagatctgaactaaaccaacttaatgagaaatctgataaactaagaggagcaaatgcaaccttgttggacaaactgaaatgctcggaacccgaaaagagagtccccgcaaatatgttgtctagagttaagaactcaggagctggagataagaacaagaaccaaggagacaatgattctaactctacaagcaaattccatcaactgctcgatacgaagcctcgagctaaagcagtagctgcaggctgaatcgatggtaattcatgtcgatttctacttaatttgtcgacataaacaaagaaaataagtgctactaatttcagaaaaacttgatagatagatagtatagtagagagagagagagagagagaggtgtgatgattattgatctataaattttcggagagagagagggagaaagagaaacttttcctccagatgaaaatttggtgttatggtttgttactgttaatatagagaggcttttctttttttataaaatggcttcctttgttgca

SEQ ID NO: 1104 - protein, 382 aa, Arabidopsis thaliana
MGNSSEEPKPPTKSDKPSSPPVDQTNVHVYPDWAAMQAYYGPRVAMPPYYNSAMAASGHPPPPYMWNPQHMMSPSGAPYAAVYPHGGGVYAHPGIPMGSLPQGQKDPPLTTPGTLLSIDTPTKSTGNTDNGLMKKLKEFDGLAMSLGNGNPENGADEHKRSRNSSETDGSTDGSDGNTTGADEPKLKRSREGTPTKDGKQLVQASSFHSVSPSSGDTGVKLIQGSGAILSPGVSANSNPFMSQSLAMVPPETWLQNERELKRERRKQSNRESARRSRLRKQAETEELARKVEALTAENMALRSELNQLNEKSDKLRGANATLLDKLKCSEPEKRVPANMLSRVKNSGAGDKNKNQGDNDSNSTSKFHQLLDTKPRAKAVAAG

SEQ ID NO: 1105 - DNA, 1240 bp, Arabidopsis thaliana
gtaaatctctctttgaaggttcctaactcgttaatcgtaactcacagtgactcgttcgagtcaaagtctctgtctttagctcaaaccatggctagtaacaaccctcacgacaacctttctgaccaaactccttctgatgatttcttcgagcaaatcctcggccttcctaacttctcagcctcttctgccgccggtttatctggagttgacggaggattaggtggtggagcaccgcctatgatgctgcagttgggttccggagaagaaggaagtcacatgggtggcttaggaggaagtggaccaactgggtttcacaatcagatgtttcctttggggttaagtcttgatcaagggaaaggacctgggtttcttagacctgaaggaggacatggaagtgggaaaagattctcagatgatgttgttgataatcgatgttcttctatgaaacctgttttccacgggcagcctatgcaacagccacctccatcggccccacatcagcctacttcaatccgtcccagggttcgagctaggcgtggtcaggctactgatccacatagcatcgctgagcggctacgtagagaaagaatagcagaacggatcagggcgctgcaggaacttgtacctactgtgaacaagaccgatagagctgctatgatcgatgagattgtcgattatgtaaagtttctcaggctccaagtcaaggttttgagcatgaaccgacttggtggagccggtgcggttgctccacttgttactgatatgcctctttcatcatcagttgaggatgaaacgggtgagggtggaaggactccgcaaccagcgtgggagaaatggtctaacgatgggactgaacgtcaagtggctaaactgatggaagagaacgttggagccgcgatgcagcttcttcaatcaaaggctctttgtatgatgccaatctcattggcaatggcaatttaccattctcaacctccggatacatcttcagtggtcaagcctgagaacaatcctccacagtaggatttctgcaataaagagtttgtacagctaatccaactgtccaacatgggtttttcttctgctctaatgactctggtttcttctctcctctctcaccgacttgaaaggtaaaaaagtgaaaaaggctttgtagatggaatcaatgtaggatttgcagtagagggcaaaaaaatgtcatatagctcaattgatcaagtcttaaaaaaaaaaaaaaaaaaaa

SEQ ID NO: 1106 - protein, 310 aa, Arabidopsis thaliana
MASNNPHDNLSDQTPSDDFFEQILGLPNFSASSAAGLSGVDGGLGGGAPPMMLQLGSGEEGSHMGGLGGSGPTGFHNQMFPLGLSLDQGKGPGFLRPEGGHGSGKRFSDDVVDNRCSSMKPVFHGQPMQQPPPSAPHQPTSIRPRVRARRGQATDPHSIAERLRRERIAERIRALQELVPTVNKTDRAAMIDEIVDYVKFLRLQVKVLSMNRLGGAGAVAPLVTDMPLSSSVEDETGEGGRTPQPAWEKWSNDGTERQVAKLMEENVGAAMQLLQSKALCMMPISLAMAIYHSQPPDTSSVVKPENNPPQ

SEQ ID NO: 1107 - DNA, 1713 bp, Arabidopsis thaliana
aaaaaaaaatatccgtctcactctctcgccgccggtaacatttcccggcgacaaaacttctctactctcaccattcctccatcgtaatctctaaattcttctccattctcttcttcctcccgatcatctcgagctcttcgtgagagattatgtgattatgtaatcgttgttgctgtagaagacgatctctaacaactgattccttcatcatcaccttcgctagatttgtaattttcagagcttgagatgttggatcttaacctcaacgctgattctcccgagtcgactcagtacggtggtgactcatacttagatcggcagacatcagacaactccgccgggaatcgagtggaagagtccggtacatcgacgtcgtcagttatcaatgccgatggagacgaagactcttgctctactcgagctttcactctcagtttcgatattttaaaagtcggaagtagtagcggcggagacgaaagccccgccgcttcagcttccgttactaaagagttttttccggtgagtggagactgtggacatctacgagatgttgaaggatcatcaagctctagaaactggatagatctttcttttgaccgtattggtgacggagaaacgaaattggtaactccggttccgactccggctccggttccggctcaggttaaaaagagtcggagaggaccaaggtctagaagttcacagtatagaggagttactttttatagaagaactggtcgatgggagtcacatatttgggattgtgggaaacaagtttatttaggtggtttcgacactgctcatgctgcagctagagcttatgatcgagctgctattaaatttagaggtgttgatgctgatatcaactttactcttggtgattatgaggaagatatgaaacaggtacaaaacttgagtaaggaagagtttgtgcatatactgcgtagacagagcacggggttttcgcgggggagttcgaagtatcgaggggttacgttacacaaatgtggtagatgggaagctaggatggggcagtttcttggtaaaaaggcttatgacaaggctgcaatcaacactaatggtagagaagcagtcacgaacttcgagatgagttcataccaaaatgagattaactctgagagcaataactctgagattgacctcaacttgggaatctctttatcgaccggtaatgcgccaaagcaaaatgggaggctctttcacttcccttctaatacttatgaaactcagcgtggagttagcttgaggatagataacgaatacatgggaaagccggtgaatacacctcttccttatggatcctcggatcatcgcctttactggaacggagcatgcccgagttataataatcccgccgagggaagagcaacagaaaagagaagtgaagctgaagggatgatgagtaactggggatggcagagaccggggcaaacaagcgccgtgagaccgcagccaccgggaccacaaccaccaccattgttctcagttgcagcagcatcatcaggattctcacatttccggccacaacctcccaatgacaatgcaacacgtggttacttttatccacacccttaacttgtaaggggacatatgagagtttttttaccatctctctctctctcaacactctagtcccctttcaaaaatgtcatttgggttttagatttttcacatacaatgatcaatttttcc

SEQ ID NO: 1108 - protein, 449 aa, Arabidopsis thaliana
MLDLNLNADSPESTQYGGDSYLDRQTSDNSAGNRVEESGTSTSSVINADGDEDSCSTRAFTLSFDILKVGSSSGGDESPAASASVTKEFFPVSGDCGHLRDVEGSSSSRNWIDLSFDRIGDGETKLVTPVPTPAPVPAQVKKSRRGPRSRSSQYRGVTFYRRTGRWESHIWDCGKQVYLGGFDTAHAAARAYDRAAIKFRGVDADINFTLGDYEEDMKQVQNLSKEEFVHILRRQSTGFSRGSSKYRGVTLHKCGRWEARMGQFLGKKAYDKAAINTNGREAVTNFEMSSYQNEINSESNNSEIDLNLGISLSTGNAPKQNGRLFHFPSNTYETQRGVSLRIDNEYMGKPVNTPLPYGSSDHRLYWNGACPSYNNPAEGRATEKRSEAEGMMSNWGWQRPGQTSAVRPQPPGPQPPPLFSVAAASSGFSHFRPQPPNDNATRGYFYPHP

SEQ ID NO: 1109 - DNA, 1036 bp, Arabidopsis thaliana
  misc_feature (1012)..(1012): n=a,t,c or g
gatttgtcattttttgtctagccaaaaaaaaaaaaaaaaaaggagagagagagagagagagagagagagagaaacgaagaaaaaaaaagaagcaaaaaacattgtgggtctccggtgattaggatcaaattagggcaccagccttatcggaggaagaagccatgggtagaaaaaaagtcgagatcaagcgaatcgagaacaaaagtagtcgacaagtcactttctccaaacgacgcaatggtctcatcgagaaagctcgacaactttcaattctctgtgaatcttccatcgctgttctcgtcgtctccggctccggaaaactctacaagtctgcctccggtgacaacatgtcaaagatcattgatcgttacgaaatacatcatgctgatgaacttgaagccttagatcttgcagaaaaaactcggaattatctgccactcaaagagttactagaaatagtccaaagcaagcttgaagaatcaaatgtcgataatgcaagtgtggatactttaatttctctggaggaacagctcgagactgctctgtccgtaactagagctaggaagacagaactaatgatgggggaagtgaagtcccttcaaaaaacggagaacttgctgagagaagagaaccagactttggctagccaggtggggaagaagacgtttctggttatagaaggtgacagaggaatgtcatgggaaaatggctccggcaacaaagtacgggagactcttccgctgctcaagtaatcaccatcatcaacggctgagctttcaccttaaacttacagcctgattcagaagtttttacaaatttgtaaattataaaaagcttcataataatctcaacctttttatcttcctcgcgccaatgtggaaattaaggttaaaaataaaataaaacagaagctcatgcgaaagaattgtaaaactaagataaagctatagtagatctttattgtaccttcgtagacgatataagatttattcgtgtgtttgtcttcccctcnaaaaaaaaaaaaaaaaaaaaaaaa

SEQ ID NO: 1110 - protein, 196 aa, Arabidopsis thaliana
MGRKKVEIKRIENKSSRQVTFSKRRNGLIEKARQLSILCESSIAVLVVSGSGKLYKSASGDNMSKIIDRYEIHHADELEALDLAEKTRNYLPLKELLEIVQSKLEESNVDNASVDTLISLEEQLETALSVTRARKTELMMGEVKSLQKTENLLREENQTLASQVGKKTFLVIEGDRGMSWENGSGNKVRETLPLLK

SEQ ID NO: 1111 - DNA, 2044 bp, Arabidopsis thaliana; identical to SEQ ID NO: 611

SEQ ID NO: 1112 - protein, 513 aa, Arabidopsis thaliana; identical to SEQ ID NO: 612

SEQ ID NO: 1113 - DNA, 1303 bp, Arabidopsis thaliana
ttttttttcttccctcttttagaactctctctctctctcgtttttgacacttatcctctctcttttttctctctccctctctctctggccggaaaaaagaacaacgtcgtttatagctaaagattcgatcatgttggatcttaacctaaagatcttttcttcttataacgaagatcaagatcggaaagtaccattaatgatctcaaccaccggtgaagaagaatctaactcatcttcctcctccacaacagactctgcagcgagagatgctttcatcgcttttggaattctcaaacgcgacgatgaccttgttcctcctcctcctcctcctcctcataaagaaacaggagatctctttccggtggtggctgatgctcgtcggaatatagaattctccgtggaagacagtcactggttgaatctttcttctttacaaagaaatacacagaaaatggtgaagaagagcagaagaggaccaaggtctcgtagctcccaatatcgtggcgtcactttttaccgtcgcaccggtcgttgggaatctcatatttgggattgtggaaagcaagtttatttgggcgggtttgatactgcttacgcagcagcaagggcttacgaccgagctgctatcaaattccgtggtctcgatgcagacatcaatttcgtcgtggatgattataggcatgacatcgataagatgaagaatttaaataaggtggagttcgtgcaaacacttaggcgagagagtgcgagtttcggaagaggaagttccaaatacaaaggcttggctcttcaaaaatgcacccaattcaaaactcatgatcagattcatctcttccaaaacaggggatgggatgcagcagcaataaaatacaatgagttgggaaagggagaaggagccatgaagtttggtgcccatatcaaaggaaatggtcacaatgatcttgaactaagtctcggaatttcatcatcatcggaaagtataaagttgacaacaggcgattactataagggtatcaatcggtccacgatgggtttatacggtaagcaatcatcgatatttttacccatggcaaccatgaaacctctgaagacagttgcagcatcatcaggattcccttttatcagcatgacaagttcctcttcctccatgtccaattgttttgatccataggatcgttctacactctcttaactaatatatatttttactctatctgattattgtatacaaggataaaatttgattctttccttaatgagtgagaaatattggaagtgttaaaaaaaaaaaaaaaaaaaaaaa

SEQ ID NO: 1114 - protein, 346 aa, Arabidopsis thaliana
MLDLNLKIFSSYNEDQDRKVPLMISTTGEEESNSSSSSTTDSAARDAFIAFGILKRDDDLVPPPPPPPHKETGDLFPVVADARRNIEFSVEDSHWLNLSSLQRNTQKMVKKSRRGPRSRSSQYRGVTFYRRTGRWESHIWDCGKQVYLGGFDTAYAAARAYDRAAIKFRGLDADINFVVDDYRHDIDKMKNLNKVEFVQTLRRESASFGRGSSKYKGLALQKCTQFKTHDQIHLFQNRGWDAAAIKYNELGKGEGAMKFGAHIKGNGHNDLELSLGISSSSESIKLTTGDYYKGINRSTMGLYGKQSSIFLPMATMKPLKTVAASSGFPFISMTSSSSSMSNCFDP

SEQ ID NO: 1115 - DNA, 768 bp, Arabidopsis thaliana
attactcatcatcaagttcctactttctctctgacaaacatcacagagtaagtaagaatggtacagacgaagaagttcagaggtgtcaggcaacgccattggggttcttgggtcgctgagattcgtcatcctctcttgaaacggaggatttggctagggacgttcgagaccgcagaggaggcagcaagagcatacgacgaggccgccgttttaatgagcggccgcaacgccaaaaccaactttcccctcaacaacaacaacaccggagaaacttccgagggcaaaaccgatatttcagcttcgtccacaatgtcatcctcaacatcatcttcatcgctctcttccatcctcagcgccaaactgaggaaatgctgcaagtctccttccccatccctcacctgcctccgtcttgacacagccagctcccatatcggcgtctggcagaaacgggccggttcaaagtctgactccagctgggtcatgacggtggagctaggtcccgcaagctcctcccaagagactactagtaaagcttcacaagacgctattcttgctccgaccactgaagttgaaattggtggcagcagagaagaagtattggatgaggaagaaaaggttgctttgcaaatgatagaggagcttctcaatacaaactaaatcttatttgcttatatatatgtacctattttcattgctgatttacagccaaaataatcaattataccgtgtattttatagatgttttatattaaaaggttgttagatata

SEQ ID NO: 1116 - protein, 199 aa, Arabidopsis thaliana
MVQTKKFRGVRQRHWGSWVAEIRHPLLKRRIWLGTFETAEEAARAYDEAAVLMSGRNAKTNFPLNNNNTGETSEGKTDISASSTMSSSTSSSSLSSILSAKLRKCCKSPSPSLTCLRLDTASSHIGVWQKRAGSKSDSSWVMTVELGPASSSQETTSKASQDAILAPTTEVEIGGSREEVLDEEEKVALQMIEELLNTN

SEQ ID NO: 1117 - DNA, 1095 bp, Arabidopsis thaliana
tgtatatatagttagttagttgagataaacttggttaccacttttgtgtggtctttctttttctttttctccattttccatttatcgaccccttgggtgtagctaattactttcgcgattttcaaatccaataaagttttaatttgatgaagctttttttaaaccatataatataaataatgggtggtcgtaaaccatgttgtgatgaggttggattaagaaagggtccatggacagtggaagaagatgggaaactagttgatttcttaagggcacgtggcaactgcggtggtggtggaggaggatggtgctggagagacgtgccaaaactggcggggctaaggaggtgtggcaaaagttgccgtctccggtggactaattatctccggccagatctcaagagaggtctttttactgaagaagaaatccaactagtcattgatcttcatgctcgccttggcaatagatggtcgaagattgcagtggagttaccaggaagaacagacaacgatatcaaaaattattggaacactcatataaagaggaagcttataagaatgggtattgatccaaacacacatcgtcgatttgaccaacaaaaagtcaacgaggaggaaacgatattggtcaacgatccaaagcctctgtctgagaccgaggtatctgttgctttgaagaatgacacgtcagcagtgttatcaggaaatctaaaccaattggctgacgtggacggtgatgatcagccgtggagctttctaatggaaaatgacgaaggaggaggtggcgacgccgccggagagcttacgatgctattgtccggtgacattacgtcatcatgttcttcttcgtcatctttgtggatgaagtatggagaattcggatacgaagatttagaacttggatgtttcgatgtttagagattcaagtatgtttaattaggccgtaggttgattaatcataaggttcattgacttcattctagaattgtgtagttggaccagtataaagaatcaaagttatgaaacattgtaatttgatttccaaattaatctaatgaataaatgtgctttgcaaaaaaaaaaaaaaaaaaaaaaa

SEQ ID NO: 1118 - protein, 245 aa, Arabidopsis thaliana
MGGRKPCCDEVGLRKGPWTVEEDGKLVDFLRARGNCGGGGGGWCWRDVPKLAGLRRCGKSCRLRWTNYLRPDLKRGLFTEEEIQLVIDLHARLGNRWSKIAVELPGRTDNDIKNYWNTHIKRKLIRMGIDPNTHRRFDQQKVNEEETILVNDPKPLSETEVSVALKNDTSAVLSGNLNQLADVDGDDQPWSFLMENDEGGGGDAAGELTMLLSGDITSSCSSSSSLWMKYGEFGYEDLELGCFDV

SEQ ID NO: 1119 - DNA, 850 bp, Arabidopsis thaliana
agcccatccttcaacattgcttcctaaccagaaatccaccatcatcttcccacgaatacaacttaaagctttaccagaaaatggagggtcagagaacacaacgccggggttacttgaaagacaaggctacagtctccaaccttgttgaagaagaaatggagaatggcatggatggagaagaggaggatggaggagacgaagacaaaaggaagaaggtgatggaaagagttagaggtcctagcactgaccgtgttccatcgcgactgtgccaggtcgataggtgcactgttaatttgactgaggccaagcagtattaccgcagacacagagtatgtgaagtacatgcaaaggcatctgctgcgactgttgcaggggtcaggcaacgcttttgtcaacaatgcagcaggtttcatgagctaccagagtttgatgaagctaaaagaagctgcaggaggcgcttagctggacacaatgagaggaggaggaagatctctggtgacagttttggagaagggtcaggccggagagggtttagcggtcaactgatccagactcaagaaagaaacagggtagacaggaaacttcctatgaccaactcatcattcaagcgaccacagatcagataaaccctcccgctctctctcttctgtcatctacatatgctctatctacactcttattagacaaataatggcatctaacaatgtcaagaaaagttggtcatggtattaaatcctacacggatatataactataaacctctagtcccctctatgctgtcctgtaatgaatatctatccggaaatgtattcgcatagtcttgcgtctaataatgtttattgattttgta

SEQ ID NO: 1120 - protein, 181 aa, Arabidopsis thaliana
MEGQRTQRRGYLKDKATVSNLVEEEMENGMDGEEEDGGDEDKRKKVMERVRGPSTDRVPSRLCQVDRCTVNLTEAKQYYRRHRVCEVHAKASAATVAGVRQRFCQQCSRFHELPEFDEAKRSCRRRLAGHNERRRKISGDSFGEGSGRRGFSGQLIQTQERNRVDRKLPMTNSSFKRPQIR

SEQ ID NO: 1121 - DNA, 525 bp, Arabidopsis thaliana
atggagggtaagagatcacaaggacaaggttacatgaaaaagaagtcttaccttgtggaagaagatatggagactgatacggatgaagaagaggaagtaggtagggatagagttagagggtctagaggtagcatcaatcgtggtggctcgttgcggctttgccaagtagatagatgcacagctgatatgaaagaggcaaaactgtatcaccggagacacaaagtgtgtgaagttcatgcaaaggcatcttctgtctttctctcaggacttaaccaacgcttttgtcaacaatgcagtaggtttcatgacctccaagagtttgatgaagctaagagaagttgcaggaggcgcttagctggacacaatgagcgaagaaggaagagctctggtgagagtacttatggagaaggatcaggtcggagaggaatcaatggtcaggtggtgatgcagaatcaagaaagatcaagggtagagatgacacttcctatgccaaactcatcattcaagcgaccacagattagatag

SEQ ID NO: 1122 - protein, 174 aa, Arabidopsis thaliana
MEGKRSQGQGYMKKKSYLVEEDMETDTDEEEEVGRDRVRGSRGSINRGGSLRLCQVDRCTADMKEAKLYHRRHKVCEVHAKASSVFLSGLNQRFCQQCSRFHDLQEFDEAKRSCRRRLAGHNERRRKSSGESTYGEGSGRRGINGQVVMQNQERSRVEMTLPMPNSSFKRPQIR

SEQ ID NO: 1123 - protein, 16 aa, Arabidopsis thaliana
  misc_feature (3)..(3): Xaa can be Lys or Arg
  misc_feature (8)..(8): Xaa can be any naturally occurring amino acid
  misc_feature (11)..(11): Xaa can be any naturally occurring amino acid
  residues that bracket CBF AP2/EREBP DNA binding domain
PKXPAGRXKFXETRHP

SEQ ID NO: 1124 - protein, 5 aa, Arabidopsis thaliana
  residues that bracket CBF AP2/EREBP DNA binding domain
DSAWR

What is claimed is:

1. A transgenic plant that has increased tolerance to freezing as compared to a control plant, a wild-type plant, or a reference plant, wherein the transgenic plant comprises an expression cassette or vector that comprises a polynucleotide that encodes a polypeptide that is at least 95% identical to SEQ ID NO: 740;
wherein ectopic expression of the polypeptide in the transgenic plant results in greater tolerance to freezing as compared to a control plant, a wild-type plant, or a reference plant.

2. The transgenic plant of claim 1, wherein polypeptide is at least 98% identical to SEQ ID NO: 740.

3. The transgenic plant of claim 1, wherein the polypeptide comprises SEQ ID NO: 740.

4. A plant tissue comprising the expression cassette or vector comprised within the transgenic plant of claim 1.

5. The transgenic plant of claim 1, wherein the expression cassette is introduced into the transgenic plant and the transgenic plant is stably transformed with the polynucleotide.

6. The transgenic plant of claim 1, wherein the expression cassette or vector comprises a constitutive, inducible, or tissue-specific promoter that regulates expression of the polypeptide in the transgenic plant.

7. The transgenic plant of claim 1, wherein the transgenic plant is selected from the group consisting of: soybean, wheat, corn, potato, cotton, rice, oilseed rape, canola, sunflower, alfalfa, sugarcane, turf, banana, blackberry, blueberry, strawberry, raspberry, cantaloupe, carrot, cauliflower, coffee, cucumber, eggplant, grapes, honeydew, lettuce, mango, melon, onion, papaya, peas, peppers, pineapple, pumpkin, spinach, squash, sweet corn, tobacco, tomato, watermelon, mint and other labiates, rosaceous fruits, and vegetable brassicas.

8. The transgenic plant of claim 1, wherein the transgenic plant is a monocot.

9. The transgenic plant of claim 1, wherein the transgenic plant is a dicot.

10. A plant seed that comprises an expression cassette or vector that comprises a polynucleotide that encodes a polypeptide that is at least 95% identical to SEQ ID NO: 740;
wherein ectopic expression of the polypeptide in a plant grown from the plant seed has greater tolerance to freezing as compared to a control plant, a wild-type plant, or a reference plant.

11. The plant seed of claim 10, wherein the polypeptide is at least 98% identical to SEQ ID NO: 740.

12. The plant seed of claim 10, wherein the polypeptide comprises SEQ ID NO: 740.

13. The plant seed of claim 10, wherein the expression cassette or vector comprises a constitutive, inducible, or tissue-specific promoter that regulates expression of the polypeptide in the plant grown from the plant seed.

14. The plant seed of claim 10, wherein the plant seed is a seed of a plant selected from the group consisting: soybean, wheat, corn, potato, cotton, rice, oilseed rape, canola, sunflower, alfalfa, sugarcane, turf, banana, blackberry, blueberry, strawberry, raspberry, cantaloupe, carrot, cauliflower, coffee, cucumber, eggplant, grapes, honeydew, lettuce, mango, melon, onion, papaya, peas, peppers, pineapple, pumpkin, spinach, squash, sweet corn, tobacco, tomato, watermelon, mint and other labiates, rosaceous fruits, and vegetable brassicas.

15. The plant seed of claim 10, wherein a plant grown from the plant seed is a monocot.

16. The plant seed of claim 10, wherein a plant grown from the plant seed is a dicot.

* * * * *